United States Patent 11,384,333 (COMPOSITIONS COMPRISING BACTERIAL STRAINS AND USE THEREOF IN CONTROLLING PATHOGENIC MICROORGANISMS) - sequence listing, part 2

SEQ ID NO: 4 - DNA, 4096210 bp, Bacillus subtilis (residues 2,048,106-4,096,210 of 4,096,210)
aggtcgttcacctgctggcggaggtcagtctacacaccttccattgaaagtgaatcctgcaggggttattccggtaatctttgcggttgcgtttttgataacgccgcggacgatcgcgtcattctttggaacaaacgatgtgacaaagtggattcaaaacaactttgataatacgcatccggtgggtatggcgatatatgttgcgttgattattgcctttacgtacttttatgcttttgtacaggtaaaccctgaacaaatggctgataaccttaaaaaacagggtggctatatcccgggggttcgtccagggaaaatgactcaagatagaattacgagcattttgtatcgacttacgtttgtgggttctatattcttagccgtgatttccattcttcctatctttttcattcaattcgctggattgcctcaaagtgcacaaattggcggaacatctttgttaattgttgtcggggtagccttggagacaatgaaacaactagaaagccagttggtgaaacgaaactaccgtggatttatgaaaaactagaggaaatggatttatccattccctcttaataaagagaggacggggggaaatccgaatgaacttagtcttaatggggcttcctggtgccggtaaaggcacacagggcgaacgaattgttgaggattatgggattcctcatatctcaacaggagatatgttccgtgctgctatgaaagaagaaacaccactcggactcgaagcaaaatcttatattgataagggagagctcgtacctgacgaagtcacaatcggaattgtaaaagagagacttggcaaagatgattgtgaaagaggttttcttctggacggatttccgcgaacagtcgctcaagccgaagctcttgaagaaattcttgaggaatacggcaagccgattgattatgtcattaacattgaagtcgacaaagacgctcttatggaacgtctgactggacgcagaatttgcagtgtttgcggcacaacctatcatttagtctttaatccgccgaaaacgccgggtatttgtgataaagacggaggcgaactctatcaacgggcagatgataatgaggaaacagtctctaaacggcttgaggtaaacatgaagcaaactcagcctttactcgatttctattcagagaaaggttatcttgcaaacgtgaatggccagcaggacattcaagacgtttatgcagatgtgaaggatcttcttggaggattaaaaaaatgattatctgtaaaaccccacgtgaacttggtatcatgcgggaagcagggcgaatcgtggctttaactcatgaagagttaaaaaagcacattaaaccaggaatctcgacaaaagaattggatcaaattgccgaacgttttattaagaagcagggtgcaatcccatcttttaaggggtataatgggtttcgcgggagcatttgcgtatcagttaatgaagaactcgttcacggcatacctggcagcagggtgctgaaggacggtgacatcatcagtattgatatcggtgctaaattaaatggttatcatggtgactctgcatggacatatccggtaggaaacatcagcgatgatgacaaaaaacttctggaagtgacagaggagtctttatataaaggcttgcaggaagcaaaaccaggtgaacgtttgtcgaatatttcccacgcaatacaaacgtatgtcgaaaatgagcagttttcagttgttagggagtatgtcggacatggtgttggtcaagacttgcatgaggacccgcaaattcctcattacggtccgcccaacaaaggaccacggcttaaacctggcatggttctcgctattgaacctatggtgaacgctggcagccgctacgtgaaaacattggctgataactggacggttgtaacggtagatgggaaaaagtgtgctcattttgaacatacgattgcgattacggaaacgggttttgatatactgacgagagtctagatgatgaaaataattccgaagacagatgtttttcaagcttgatagggcagaaagcttgggtgaacattggcaagaccgaattcatcttgctgcttgtcgttggaattttaaccatcatcaatgtactaacagcagacggagaaaagcgtacatttcattctcctaagaaaaagaatatcaatcatttaaccctttatgattgcgtatctccggaagttcagaacagtataaacgaaacagggcgtgtgacaaacttcttttgaaatttgtcagaaagcaagttactgatttgaagaagggagaacacttgaatggcgaaagacgatgtaattgaagtggaaggtactatagtcgaaacactgccaaacgcgatgttcaaagttgaacttgaaaatggccacactgttttggctcatgtatctggtaaaatccgcatgcacttcattcgcattttacctggagacaaagttacggtagaattatctccatatgacttaactcgtggcaggattacgtaccgttacaaataaagcactccggaaactgaaggaggttggaaacacatgaaagtgagaccatcagttaaaccaatctgcgaaaaatgtaaagttattcgcagaaaaggaaaagtaatggtgatctgtgaaaatccaaagcataaacaaaaacaaggataatttataaggaggtgcccagagaatggctcgtattgctggtgtagatatcccacgtgacaaacgtgttgttatttctttaacatacatcttcggaattggccgcacaacggctcagcaagttttaaaagaagctggagtttcagaagatactcgtgtgcgcgatcttactgaagaagaacttggtaaaatccgtgatattattgacaaactgaaagtagaaggtgaccttcgccgtgaagtttctcttaatatcaaacgtctgatcgaaatcggaagctaccgcggaatccgtcatcgcagaggattacctgttcgcggacaaaactctaaaaacaacgcgcgtactcgtaaaggtccgcgtcgtactgtagctaacaagaaaaaataagtaagggaggttcttaaacaatggctgctgctcgtaaatctaacacgcgtaaacgtcgcgtgaaaaagaatattgagtctggaattgctcatattcgttcaactttcaataacacgatcgttacgatcactgacactcatggtaatgctatttcttggtctagtgccggagctttaggattcagaggttctcgtaaatctactccttttgctgcgcaaatggctgcagaaacagctgctaaaggttcaatcgaacatggtcttaaaactctagaggttactgttaaaggacctggttcaggccgtgaagctgcaatccgtgcacttcaagctgctggactagaagtcactgctatcagagacgtaactcctgttcctcataacggatgccgtccaccaaaacgtcgccgcgtgtaatttgtttgtatagattttgtgtccctgtcaataatgggttatgatacagttatttatgaaacgaatgcaccgactcgttgcctgagcacatacgggactaaacaatggggaatttcggatggaatctcatatgattctattcgaggtttcgacgttttgaaggagggttttaagtaatgatcgagattgaaaaaccaaaaatcgaaacggttgaaatcagcgacgatgccaaatttggtaagtttgtcgtagagccacttgagcgtggatatggtacaactctgggtaactccttacgtcgtatcctcttatcctcactccctggtgccgctgtaacatcaatccagatagatggtgtactgcacgaattctcgacaattgaaggcgttgtggaagatgttacaacgattatcttacacattaaaaagcttgcattgaaaatctactctgatgaagagaagacgctagaaattgatgtacagggtgaaggaactgtaacggcagctgatattacacacgatagtgatgtagagatcttaaatcctgatcttcatatcgcgactcttggtgagaatgcgagtttccgagttcgccttactgctcaaagaggacgtgggtatacgcctgctgacgcaaacaagagagacgatcagccaatcggcgtgattccgatcgattctatctatacgccagtttctcgtgtatcttatcaggtagagaacactcgtgtaggccaagttgcaaactatgataaacttacacttgatgtttggactgatggaagcactggaccgaaagaagcaattgcgcttggttcaaagattttaactgaacaccttaatatattcgttggtttaactgacgaagctcaacatgctgaaatcatggttgaaaaagaagaagatcaaaaagagaaagttcttgaaatgacaattgaagaattggatctttctgttcgttcttacaactgcttaaagcgtgcgggtattaacacggttcaagagcttgcgaacaagacggaagaagatatgatgaaagttcgaaatctaggacgcaaatcacttgaagaagtgaaagcgaaactagaagaacttggactcggacttcgcaaagacgattgactagtttcccttgtgaactaggattttcgtgtgtttattattcagaaacagcattccaataaaggaggggacatcacatgtcatacagaaaactaggacgtacgagtgcacagcgtaaagctatgcttcgtgatcttacaactgatttgatcatcaacgaaagaatcgaaacaactgaaacacgtgcgaaagaacttcgctctgtagttgaaaaaatgatcacgcttggcaaacgcggtgatcttcacgctcgccgtcaagctgctgcatacatccgcaacgaggttgcaaacgaagaaaataaccaagatgcacttcaaaaattattctctgacattgcaactcgttacgaggagcgccaaggcggatacacacgtattatgaagcttggtcctcgccgtggtgacggagcaccaatggcaattatcgaattggtttaatcacatatttttgtgtatctaaagaagggcgggacagtttctaactggatctatgccctttttttagatactgcaacttttaatatagagagaaaagcagagcattagctgagaggaggccggttttccatgaatcaaaatcagttgatatcggtagaggatatcgtatttcgatatcggaaggacgcagaaagacgagcactagacggcgtctccctgcaggtgtatgagggtgaatggcttgcaatcgtaggtcataacggttcagggaaatcaacactggcccgggcattgaatggtttaattcttcctgaatcaggcgacattgaggttgccgggattcaattaacagaggaatctgtttgggaagtgcgtaagaagataggtatggtctttcaaaatccggataaccaatttgtcggaacgactgttcgcgatgatgtggcttttggtttagaaaacaatggtgtaccgcgggaagaaatgattgagagagtagactgggcagtaaaacaggtgaatatgcaagattttctcgatcaagagccgcaccatctctccggaggccaaaagcagagagttgcgattgcgggggttattgccgcacgtcctgatattattatcttagatgaagcaacatccatgcttgatccgatcgggcgagaagaagtgcttgaaacggtaagacatttaaaagagcagggaatggcgactgtcatatccattacacatgatctggatgaggcagcaaaagcagacaggatcattgtcatgaatggcggtaaaaaatatgctgaagggccgcctaaagagatttttaaattgaataaagaacttgttcgaatcgggcttgatttacccttctcattccagcttagccagcttttaagagaaaatggactggctttggaagaaaaccatttgactcaggaagggctggtgaaagagctgtggacattacaatcaaagatgtagagcatcgctatcagatgaagacgccgtttgagcgcctagcactgtatgatatcaatgcatcgattaaagaaggaagctacgtagcagttatcgggcatacaggctctggcaagtccactcttcttcagcacctaaatggtctcctaaagccgacgaagggacagatatcactaggcagcactgtcattcaggcagggagaaagaataaagatctgaaaaaacttcgtaaaaaagtcggaatcgttttccaatttcctgagcatcaattattcgaagaaacagttcttaaagatatttcattcggaccgatgaactttggtgttaaaaaagaagatgctgaacaaaaagcgagagagatgctgcagcttgtaggtttatcagaagagcttttggacaggtcaccctttgaattaagcgggggacaaatgcgcagagttgcaattgccggcgtacttgcaatggaccctgaagtgcttgttctggatgaaccgactgcaggattggacccaagagggcgaaaagagattatggacatgttttatgagcttcatcaacgtgggaacttgacgacgatccttgtgacacacagcatggaggatgcagctgcatacgctgatgaaatgattgttatgcataaaggaacgatacaagcatcaggcagtccgcgtgatctgtttttaaagggtgaagagatggccggctgggggctggatcttcctgaaacaataaaattccaaagacaccttgaagctgcactgggtgtgagatttaatgagcctatgctcacaatcgaagatgccgctgccgaaatccgtgctctttttcagggagagaagactttatgatggacagcatgattatcggcaagtatgtaccggggacttcacttgtgcaccggcttgaccccagaacaaaactgatcacgatctttttatttgtctgcattgtattcttagccaataatgttcagacatatgcgttgcttggtttatttacaattggcgtcgtttctttaacaagagttcctttctcttttttaatgaaagggctgaagccaatcatctggattgtcctttttacgttccttcttcacattcttatgacacatgaaggaccgattatctttcaaataagttttttcaaagtctatgagggcggtctggttcaggggatattcatttctcttagattcgtctatttgattttaatcacaaccttattaacgcttacgactacaccgattgagattaccgatggaatggagcagctgctgaacccattgaaaaaattaaagcttcctgttcatgagctggctcttatgatgtcaatttctttacggtttattccgacactgatggaggagacagataagatcatgaaggctcagatggcgcgaggcgttgattttacaagcgggcctgtcaaagaaagagtgaaggctattgtcccgcttcttgtcccgctcttcgtcagcgcatttaaacgcgccgaagagcttgcggtggcaatggaagcaagaggctatcaaggcggagaaggacgtacgaaatatagaaagcttgtatggacaggaaaagacacttctgtcattgtcagcttaattgtattagctgctttgttatttttcttaagggcttagaggtgctgtatgagactgaaatgcacgatttcttatgacggacatttgtttaacggttatcaggttcagccgggcaaaagaacggttcaggatgaactggagaaagctttggctgtcctgcataagtcaaaagacagaattccggtcgtttcgtctggaagaacagacagcggggttcacgcagccggacaggtgattcattttgacactccgctgtctatcccggctgagagatggccatatgccttaaatgcactgcttccggacgatatcgcagtcaaacaggcagaaattgcggatgatgggttccatgcacgatttagcgcagtcaaaaaagaatatcgctactttgtatacacggagaaacacccggacgtatttaaacggcattacgcttaccatttttcatatcgccttaatgtgcaggacatgagagaagcggcaaagcatcttatagggacacatgattttacgagcttttgcgcggctaaaacagaagtgcaggacaaggtaagaacgatatacgaacttgattggactgagacggctgacggcctgcaaatgcggatcacaggcagcggtttcttatataatatggtcagaattattgcgggtactttgcttgatgcaggtattggaaaaatttctcacgatgaggtgaaatccatgctggaagcgaaggatcgcgaagcggcagggcgcacagcgccgggacacgggctatatttatggaacgtttactatgacaactaaaccaggtgtataatattttcttgacagagtctgcataaagttataagatatcatatggtatgtatttcaaccccacgataagccccggaacttattgtgttgtgaaatagaacgtaatcgaagtttattgaaaatgacagatcatttaggagggaaattcaatgcgtacaacacctatggctaacgcaagtactattgaacgcaagtggttagttgttgatgctgctggcaagactttaggtcgtctttcttcagaagttgcagctatccttcgcggaaaacacaaaccaacttacacaccacacgttgatactggagatcatgtgatcatcatcaacgctgaaaaaatcgagttaactggtaaaaagttaactgacaaaatctactaccgtcacactcaacatccaggcggattaaaatcaagaactgctcttgaaatgcgtacaaactaccctgagaaaatgcttgagcttgctatcaaaggcatgcttccaaaaggttctctaggtcgtcaaatgttcaaaaaattgaacgtataccgtggttctgagcatccacacgaagcacaaaaacctgaagtttacgaacttcgcggttaattaaaaaggaggttaccaatttggcacaggttcaatattacggtactggccgtcgtaaaagctctgtagcgcgtgtgcgtttagttccaggagaaggccgtatcgtcgtaaataatcgtgaaatcagcgaacacatcccatctgcagctttaatcgaagatatcaaacaaccattaactttgactgaaacagctggcacttatgatgttttagtaaacgtacatggaggcggcttatctggtcaagctggagcaatccgtcacggtatcgctcgtgctttgcttgaagcagatccagaataccgtacaactcttaaacgtgcaggtcttctgactcgtgacgctcgtatgaaagaacgtaaaaaatacggtcttaaaggcgctcgtcgtgcacctcagttctcaaaacgttaattttacgttttcaaaaagctctcgaccttgggttgggagcttttttctttcaataaaacgtggcagcttcgcataaaaataacaactgaatggacgcttgacggggttaagcaaattgtttgtttataaacggtcttactgtaataatcatgatagctttcattcttattcaattggaaattcggtcaatgtttattatcgttatgtgatcagcccagctccatctaaccactgtatctcatccgttaaagttcactgctgattcttaacccggagaacaatagctctcattgctaatggctttatgtaacgaagtaaaagtaaatctgatgatataaatcacatatctcctttgtgatttttttgcgtttttatgaacttttttctaaatatgcaaagggaaagcgatatcaatctagaaatatttgttatactctatacattaaagtaaggagaagattcatgaatgcgttagtagctcataatagcaaagcctgggataaaaaagtagaaacaggcaatgaatggactgttgctgttgagcagcaggttatcgaacaagcaaaaaaaggaaattgggatataagggtaacaccaatgaaagatgtaccgaaggattggtttccgcctgtcaaaggactgaaagtactctgtttagcatcaggcggcggccagcagggtccagttttggcagccgcaggcgcggatgtcaccgtactagataactcagaaaaacagctgaatcaggatagaatgattgctgagcgagatggtctcacgatacacactgtcaaaggaagcatggacgatttaagtgtatttaatgatgaatcatttgatgtcattgtacatcctgttgccaatgtttttgttgagaatgtcctcccggtatggaaggaagcgcaccgtgtgttgaaaaggaacggcgttctaatctcgggttttgtcaatcctgttgtatttctgtttgatacagaattagaacagcaaggtgttttaaaagtaaaacactccattccatatgctgacccagaagatcttccgaaacataaagtgaaaaaactgatcgaaaataatgaggctctggaattcggccattccttagaagaccaaatcaaaggccaaattgatgccggttttatcgttactggtttttatgaagataaaggcgggtttgtattagaccaatatatccatacatattctgcaacaagaagcatgaaagtatgaaaagcagcgacctgttagaggggctgcttttttcataactacttacagaacatttgttccggatcctgcggaaagctgattttttatcgattttacaccttcatttgggcgaatttccaaccgaattcgggcattgtttcatcatccaaacctcaaaataatcggtaaaaggagagtgaatttatatggcagaagtactgtcttttatggatgtgaaacgccaaaaggattttgaattagaaaagaacttgctcaaagaactctctctgagacaaattatccagtctgttaaggattgtttggaaccattatttccatttttacatgatgaacgagatattattaccgaaggctgtattgattttgctatagaagcctatttgttaggcgggcgttttgggatattcggctattacggagaatccatgcagagtatcagtgcccgctctgcaagagaagaagaagagctgcgtatggagttttttgattatctctataattggatacacgagcaatacgcaacatttgataaaaacactgtttatgaagcggcacgcaagttcattaaagattggtggacagcagggtttgttcaaagagaaaaacagtgtaagcttcgcatgcggtaatcatatttcccggccctgtcccatagttatgtaataacggacaagcgggaggggaagggatgaggaaaaagcttaaatggctcagttttttgctaggcttcatcatattactatttctgttcaagtatcagttcagcaataacgactcttggaagccgtggagcctgcccttgagcggtaaaattatttatctagatccaggtcatggcgggcctgacggcggagcagtcggcggaaagctgttagagaaggatgttaccctggaagtggcttttagagtcagggattatcttcaagaacaaggagcgcttgttatcatgaccagagaaagtgatactgatctcgctccagaaggaacaaaaggctatagccgacgaaaagctgaggatctaagacaacgagtcaaattaataaaccattcagaggcggagctctatatcagcattcatcttaatgcgattccgtcacaaaagtggagcggagcccaaagcttttattacgggaaatatgcggaaaatgagaaagtcgcaaaatacattcaggatgagctgagaagaaatctggaaaacacaacccggaaagcaaagcggattcatggtatctacttaatgcaaaacgtcaccaaaccgggggcgcttatagaagtcggatttttatccaatccaagtgaagcaacgttgctcggtaaaccgaaatatcaagacaaggtggcatcttccatatataaaggcattttgcgatatttcacagaaaaaggagaccctccggagtaatggagggttttcttgtggttctaagcataagacacccgccatttatgtatgatataataatagttgtaaacgaatacacaaaagggtgaggttcgatgataagagaagatgaagtaagaaaactagtcggagaaatgcgcgaaccttttcttcaaagacctctgggagaattggatgccgttaaggaaattaaaataaagcctgaaaaacggcatatcagtgtaaaagtcgctcttgcaaaaacaggaactgcagaacaaatgcagattcagcaagagatcgtaaacgtattaaaaggggcaggagctgagacagtcggccttcgatttgaagagctgcctgaagaaacggttgctaaatttcgggcgccgtcagctgagaaaaaaacattattaaatatggataacccgccagtctttcttgccgtagcaagcggaaaaggcggcgtaggcaagtcaactgtgtccgtaaacctagctatttctctggctcgtctagggaaaaaggttggtttaattgatgcggatatttatgggttcagtgtgccggacatgatgggtatcactgtgcgtccaacgattgaaggagagaaacttcttcctgttgaacgctttggagtaaaggtcatgtcaatgggctttttcgtagaagaaaatgctccggtcgtatggagagggccgatgctcggcaaaatgctgaataactttttccatgaagtagagtggggagaagtagactatatcgttcttgatcttccgcctggtacaggggatgttgctctcgatgtacatacaatgcttccgagctgcaaagaaatcatagtatctacgccgcatccgactgctgcttttgtcgcggccagagcgggctctatggcgattaaaaccgatcatgaggtcgtgggggtcatagagaacatggcttattatgaaagtgcaaagacaggggaaagagaatatgtctttggaaaaggcggaggagataaactggctgaggaactaaatgtgcctttgctcggcagaatcccattgaaacagccagattgggataaggaccaatttgctccgtctgtttatgacgaaaatcatccaatcggagaaatatatcaggacatcgcagaaaaaatagatgcaaaaatgtcagtgcaggtataaaaggtgaaccgggattccagatcccggctttccctttattcactttctttggctgtgtcttttgctgcttttttcagctcatcttcgaactgctttttgtaaagcgggctagaaagtgtttcgttaataacctcttctaaataactgcggaattcttggctttttgccagctggctatactttttatccatgccgggatcctgcataacgctcatcagcatcttctggtaatctggatccttcatcagctttttaatcactttttcatgctctgtctgaagagttttggcaaagccctcagcaaaatcagtgtcttcaaagatgtttttccaaaattcttcgccttttttagatgtgagtgttttttctattgttcctttaattgcatcttgatcaatcaccagcgcttcattcatggcatcatcatttaataattccttaatagctttctttccatcatcagtttttaatatatcaacaaccatttttttggtttgatcatagtccatatccgctgcttggtcttttggagcgcaagctgttacagataataacaaaaaacagctcatcaatagcgttttggcttttgacatgcttaagctcctttcacatacttgtcttacctttaatatgattcatctgtttggaattatacataacaaaatatcgctgttcgcgatttttgaggggatgaataaagaaatgaaaagccgtggtttagttcgttttttcttttctattttagctgtcggagcgcttatcacgagtattgtgggttttgctttaaaatggggagaatatagggggctgtttcttacatttgaagcggggcagattttctctgttttattttggtttatcggtgtaggcatgattttcagtgtgatcagccaaatgggttttttcgtgtttttaacagttcatcggtttgcgcttgagatattaaggtcctcctctttgtggaatttgctgcagttgtttttcatcctgtttgttgcttttgatttaatgtacgtgcgttttttattttttggagagagcggagaatcgctggctggctatgcgtggttaccggtgtttttattgatctttggagtgattacagcttatataaagcaaaagcagtcctctaagaaaacatttgtgtcatcattatttttgatggtcgtgattaccgcattagaatggttccctgcattaagagtaaatgatgaggactggctttatttaatgctttttccgttaatggcatgtaatgccttccaattgctgatgctgccgaagtttgcagcaaagtaattactttacctctgcggatttggcatcagaatttgcgatgaggtcacccacggttacattttttaatcctttttctttcagctgatggatgatatcaggcaatgcttcttctgtttgttttgccgaatcggaggcatgtaaaagaataatgtctccaccggaaacttgcttggtcacattgtcgatgattttttcaactccgggatttgtccagtcttgagagttcacactgtaatgaacgactgtataattgtattgctttgcgacctttagaacattcttattgaattggccggtagggggtcttaatagctgtatgtctttgacccctaacttttcaaaggctgtttgcgcacggtttatgtccttttttatttcgctgctctctaaattggcatagtttttataagcgtagcccatgctcccaatttgatgtccatcctttacgatacgggccactgtgtcgggatggcgttctgcccaagaagcggacaggaaaaacgttgcgtttttaatcccgtttgctttcagagtattaagtatcggttctgctctctcatcaccccagctgatatcgaaagtaagtgaaatatctttagagtctgtttctcctttataaatggctttaggtccggtgtcagttgaaaacacgggaagcgggacagctctttggatataaaaaaagctggcagctgcaaatgcggcgataagtataataattaattgtttcacccgtttaatgtgccacacatagaagtgattcactgatgatgcctccttatcttgtccatcattcttgttttacatcttatgagcatggacaattgaatataaccgataaaatgtctcttcacatacagcctaaattgggtgttgaccttttgatgatatccgtgatatattattattcgtcgctgataaacagctgacatcaactaaaagcttcattaagtactttgaaaaaagttgttgacttaaaagaagctaaatgttatagtaataaagctgcttcgttaagcggcggtaatgatctttgaaaactaaacaagacaaaacgtacctgttaattcagtttttaaaaatcgcacagcgatgtgcgtagtcagtcaaactactttatcggagagtttgatcctggctcaggacgaacgctggcggcgtgcctaatacatgcaagtcgagcggacagatgggagcttgctccctgatgttagcggcggacgggtgagtaacacgtgggtaacctgcctgtaagactgggataactccgggaaaccggggctaataccggatggttgtttgaaccgcatggttcaaacataaaaggtggcttcggctaccacttacagatggacccgcggcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtaccgttcaaatagggcggtaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggacgtccccttcggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaaccttttaggagccagccgccgaaggtgggacagatgattggggtgaagtcgtaacaaggtagccgtatcggaaggtgcggctggatcacctcctttctaaggatattatacggaatataagaccttgggtcttataaacagaacgttccctgtcttgtttagttttgaaggatcattccttcgaaacgtgttctttgaaaactagataacagtagacatcacattcaattagtaacacaagatatcacatagtgattctttttaacggttaagttagaaagggcgcacggtggatgccttggcactaggagccgatgaaggacgggacgaacaccgatatgcttcggggagctgtaagcaagctttgatccggagatttccgaatggggaaacccaccactcgtaatggagtggtatccatatctgaattcataggatatgagaaggcagacccggggaactgaaacatctaagtacccggaggaagagaaagcaaatgcgattccctgagtagcggcgagcgaaacgggattagcccaaaccaagaggcttgcctcttggggttgtaggacactctatacggagttacaaaagaacgaggtagatgaagaggtctggaaaggcccgccataggaggtaacagccctgtagtcaaaacttcgttctctcctgagtggatcctgagtacggcggaacacgtgaaattccgtcggaatccgggaggaccatctcccaaggctaaatactccctagtgaccgatagtgaaccagtaccgtgagggaaaggtgaaaagcaccccggaaggggagtgaaagagatcctgaaaccgtgtgcctacaagtagtcagagcccgttaacgggtgatggcgtgccttttgtagaatgaaccggcgagttacgatcccgtgcaaggttaagcagaagatgcggagccgcagcgaaagcgagtctgaatagggcgcatgagtacgtggtcgtagacccgaaaccaggtgatctacccatgtccagggtgaagttcaggtaacactgaatggaggcccgaacccacgcacgttgaaaagtgcggggatgaggtgtgggtaggggtgaaatgccaatcgaacctggagatagctggttctctccgaaatagctttagggctagcctcaaggtaagagtcttggaggtagagcactgattggactaggggccctaccgggttaccgaattcagtcaaactccgaatgccaatgacttatccttgggagtcagactgcgagtgataagatccgtagtcgaaagggaaacagcccagaccgccagctaaggtcccaaagtatacgttaagtggaaaaggatgtggagttgcttagacaaccaggatgttggcttagaagcagccaccatttaaagagtgcgtaatagctcactggtcgagtgactctgcgccgaaaatgtaccggggctaaacgtatcaccgaagctgcggactgttcttcgaacagtggtaggagagcgttctaagggctgtgaagccagaccggaaggactggtggagcgcttagaagtgagaatgccggtatgagtagcgaaagaggggtgagaatcccctccaccgaatgcctaaggtttcctgaggaaggctcgtccgctcagggttagtcgggacctaagccgaggccgaaaggcgtaggcgatggacaacaggttgatattcctgtaccacctcctcaccatttgagcaatgggggacgcaggaggatagggtaagcgcggtattggatatccgcgtccaagcagttaggctgggaaataggcaaatccgtttcccataaggctgagctgtgatggcgagcgaaatatagtagcgaagttcctgattccacactgccaagaaaagcctctagcgaggtgagaggtgcccgtaccgcaaaccgacacaggtaggcgaggagagaatcctaaggtgatcgagagaactctcgttaaggaactcggcaaaatgaccccgtaacttcgggagaaggggtgctctgttagggtgcaagcccgagagagccgcagtgaataggcccaggcgactgtttagcaaaaacacaggtctctgcgaagccgtaaggcgaagtataggggctgacgcctgcccggtgctggaaggttaagaggagcgcttagcgtaagcgaaggtgcgaattgaagccccagtaaacggcggccgtaactataacggtcctaaggtagcgaaattccttgtcgggtaagttccgacccgcacgaaaggcgcaacgatctgggcactgtctcaacgagagactcggtgaaattatagtacctgtgaagatgcaggttacccgcgacaggacggaaagaccccgtggagctttactgcagcctgatattgaatgttggtacagcttgtacaggataggtaggagccttggaaaccggagcgctagcttcggtggaggcatcggtgggatactaccctggctgtattgaccttctaacccgccgcccttatcgggcggggagacagtgtcaggtgggcagtttgactggggcggtcgcctcctaaaaggtaacggaggcgcccaaaggttccctcagaatggttggaaatcattcgcagagtgtaaaggcacaagggagcttgactgcgagacctacaagtcgagcagggacgaaagtcgggcttagtgatccggtggttccgcatggaagggccatcgctcaacggataaaagctacccggggataacaggcttatctccccaagagtccacatcgacggggaggtttggcacctcgatgtcggctcatcgcatcctggggctgtagtcggtcccaagggttgggctgttcgcccattaaagcggtacgcgagctgggttcagaacgtcgtgagacagttcggtccctatccgtcgcgggcgcaggaaatttgagaggagctgtccttagtacgagaggaccgggatggacgcaccgctggtgtaccagttgttctgccaagggcatcgctgggtagctatgtgcggacgggataagtgctgaaagcatctaagcatgaagcccccctcaagatgagatttcccattccgcaaggaagtaagatccctgaaagatgatcaggttgataggtctgaggtggaagtgtggcgacacatggagctgacagatactaatcgatcgaggacttaaccatattgttgaatgatgtcacacctgttatctagttttgagagaacactctcaatttgtttggtggcgatagcgaagaggtcacacccgttcccataccgaacacggaagttaagctcttcagcgccgatggtagtcgggggtttccccctgtgagagtaggacgccgccaagcagatttattaattctaccatgtttgtttatgaagctttatattattccgcagtagctcagtggtagagctatcggctgttaaccgatcggtcgtaggttcgaatcctacctgcggagccattgcttccatagctcagcaggtagagcacttccatggtaaggaagaggtcagcggttcgagcccgcttggaagctttattaaatgtattattaccaaggtttctcataaggagaaagctttttttattgcgatatgcggaagtagttcagtggtagaacaccaccttgccaaggtgggggtcgcgggttcgaatcccgtcttccgctccatttatcccaacgggatattgtaaattgaattgcgcccgtagctcaattggatagagcgtttgactacggatcaaaaggttaggggttcgactcctctcgggcgcgccatatcttttaatagaatagataggaaatcgggaagtagctcagcttggtagagcacatggtttgggaccatggggtcgcaggttcgaatcctgtcttcccgaccattttttatggggccttagctcagctgggagagcgcctgctttgcacgcaggaggtcagcggttcgatcccgctaggctccaccaaaagtttttaaaaaaagttgttgactttgaagaggtgacattgtatactaataaagttgctttaacaaagcggacaaaatgatctttgaaaactaaacaagacaaaacgtacctgttaattcagtttttaaaaatcgcacagcgatgtgcgtagtcagtcaaactactttatcggagagtttgatcctggctcaggacgaacgctggcggcgtgcctaatacatgcaagtcgagcggacagatgggagcttgctccctgatgttagcggcggacgggtgagtaacacgtgggtaacctgcctgtaagactgggataactccgggaaaccggggctaataccggatggttgtttgaaccgcatggttcaaacataaaaggtggcttcggctaccacttacagatggacccgcggcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtaccgttcgaatagggcggtaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccgctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggacgtccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaaccttttaggagccagccgccgaaggtgggacagatgattggggtgaagtcgtaacaaggtagccgtatcggaaggtgcggctggatcacctcctttctaaggatattatacggaatataagaccttgggtcttataaacagaacgttccctgtcttgtttagttttgaaggatcattccttcgaaacgtgttctttgaaaactagataacagtagacatcacattcaattagtaacacaagatatcacatagtgattctttttaacggttaagttagaaagggcgcacggtggatgccttggcactaggagccgatgaaggacgggacgaacaccgatatgcttcggggagctgtaagcaagctttgatccggagatttccgaatggggaaacccaccactcgtaatggagtggtatccatatctgaattcataggatatgagaaggcagacccggggaactgaaacatctaagtacccggaggaagagaaagcaaatgcgattccctgagtagcggcgagcgaaacgggattagcccaaaccaagaggcttgcctcttggggttgtaggacactctatacggagttacaaaagaacgaggtagatgaagaggtctggaaaggcccgccataggaggtaacagccctgtagtcaaaacttcgttctctcctgagtggatcctgagtacggcggaacacgtgaaattccgtcggaatccgggaggaccatctcccaaggctaaatactccctagtgaccgatagtgaaccagtaccgtgagggaaaggtgaaaagcaccccggaaggggagtgaaagagatcctgaaaccgtgtgcctacaagtagtcagagcccgttaacgggtgatggcgtgccttttgtagaatgaaccggcgagttacgatcccgtgcaaggttaagcagaagatgcggagccgcagcgaaagcgagtctgaatagggcgcatgagtacgtggtcgtagacccgaaaccaggtgatctacccatgtccagggtgaagttcaggtaacactgaatggaggcccgaacccacgcacgttgaaaagtgcggggatgaggtgtgggtaggggtgaaatgccaatcgaacctggagatagctggttctctccgaaatagctttagggctagcctcaaggtaagagtcttggaggtagagcactgattggactaggggccctaccgggttaccgaattcagtcaaactccgaatgccaatgacttatccttgggagtcagactgcgagtgataagatccgtagtcgaaagggaaacagcccagaccgccagctaaggtcccaaagtatacgttaagtggaaaaggatgtggagttgcttagacaaccaggatgttggcttagaagcagccaccatttaaagagtgcgtaatagctcactggtcgagtgactctgcgccgaaaatgtaccggggctaaacgtatcaccgaagctgcggactgttcttcgaacagtggtaggagagcgttctaagggctgtgaagccagaccggaaggactggtggagcgcttagaagtgagaatgccggtatgagtagcgaaagaggggtgagaatcccctccaccgaatgcctaaggtttcctgaggaaggctcgtccgctcagggttagtcgggacctaagccgaggccgaaaggcgtaggcgatggacaacaggttgatattcctgtaccacctcctcaccatttgagcaatggggggacgcaggaggatagggtaagcgcggtattggatatccgcgtccaagcagttaggctgggaaataggcaaatccgtttcccataaggctgagctgtgatggcgagcgaaatatagtagcgaagttcctgattccacactgccaagaaaagcctctagcgaggtgagaggtgcccgtaccgcaaaccgacacaggtaggcgaggagagaatcctaaggtgatcgagagaactctcgttaaggaactcggcaaaatgaccccgtaacttcgggagaaggggtgctctgttagggtgcaagcccgagagagccgcagtgaataggcccaggcgactgtttagcaaaaacacaggtctctgcgaagccgtaaggcgaagtataggggctgacgcctgcccggtgctggaaggttaagaggagcgcttagcgtaagcgaaggtgcgaattgaagccccagtaaacggcggccgtaactataacggtcctaaggtagcgaaattccttgtcgggtaagttccgacccgcacgaaaggcgcaacgatctgggcactgtctcaacgagagactcggtgaaattatagtacctgtgaagatgcaggttacccgcgacaggacggaaagaccccgtggagctttactgcagcctgatattgaatgttggtacagcttgtacaggataggtaggagccttggaaaccggagcgctagcttcggtggaggcatcggtgggatactaccctggctgtattgaccttctaacccgccgcccttatcgggcggggagacagtgtcaggtgggcagtttgactggggcggtcgcctcctaaaaggtaacggaggcgcccaaaggttccctcagaatggttggaaatcattcgcagagtgtaaaggcacaagggagcttgactgcgagacctacaagtcgagcagggacgaaagtcgggcttagtgatccggtggttccgcatggaagggccatcgctcaacggataaaagctaccccggggataacaggcttatctccccaagagtccacatcgacggggaggtttggcacctcgatgtcggctcatcgcatcctggggctgtagtcggtcccaagggttgggctgttcgcccattaaagcggtacgcgagctgggttcagaacgtcgtgagacagttcggtccctatccgtcgcgggcgcaggaaatttgagaggagctgtccttagtacgagaggaccgggatggacgcaccgctggtgtaccagttgttctgccaagggcatcgctgggtagctatgtgcggacgggataagtgctgaaagcatctaagcatgaagcccccctcaagatgagatttcccattccgcaaggaagtaagatccctgaaagatgatcaggttgataggtctgaggtggaagtgtggcgacacatggagctgacagatactaatcgatcgaggacttaaccatatttttgaatgatgtcacacctgttatctagttttgagagaacactctcaatttgtttggtggcgatagcgaagaggtcacacccgttcccataccgaacacggaagttaagctcttcagcgccgatggtagtcgggggtttccccctgtgagagtaggacgccgccaagcaattgcacgttagtgtaattttttaaaaaagttgttgactttgaagaagtgacgttgtatactaataaagttgctttaacaaagcggacaaacaaaatgatctttgaaaactaaacaagacaaaacgtacctgttaattcagtttttaaaaatcgcacagcgatgtgcgtagtcagtcaaactactttatcggagagtttgatcctggctcaggacgaacgctggcggcgtgcctaatacatgcaagtcgagcggacagatgggagcttgctccctgatgttagcggcggacgggtgagtaacacgtgggtaacctgcctgtaagactgggataactccgggaaaccggggctaataccggatggttgtttgaaccgcatggttcaaacataaaaggtggcttcggctaccacttacagatggacccgcggcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtaccgttcaaatagggcggtaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggacgtccccttcggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaaccttttaggagccagccgccgaaggtgggacagatgattggggtgaagtcgtaacaaggtagccgtatcggaaggtgcggctggatcacctcctttctaaggatattatacggaatataagaccttgggtcttataaacagaacgttccctgtcttgtttagttttgaaggatcattccttcgaaacgtgttctttgaaaactagataacagtagacatcacattcaattagtaacacaagatatcacatagtgattctttttaacggttaagttagaaagggcgcacggtggatgccttggcactaggagccgatgaaggacgggacgaacaccgatatgcttcggggagctgtaagcaagctttgatccggagatttccgaatggggaaacccaccactcgtaatggagtggtatccatatctgaattcataggatatgagaaggcagacccgggaactgaaacatctaagtacccggaggaagagaaagcaaatgcgattccctgagtagcggcgagcgaaacgggattagcccaaaccaagaggcttgcctcttggggttgtaggacactctatacggagttacaaaagaacgaggtagatgaagaggtctggaaaggcccgccataggaggtaacagccctgtagtcaaaacttcgttctctcctgagtggatcctgagtacggcggaacacgtgaaattccgtcggaatccgggaggaccatctcccaaggctaaatactccctagtgaccgatagtgaaccagtaccgtgagggaaaggtgaaaagcaccccggaaggggagtgaaagagatcctgaaaccgtgtgcctacaagtagtcagagcccgttaacgggtgatggcgtgccttttgtagaatgaaccggcgagttacgatcccgtgcaaggttaagcagaagatgcggagccgcagcgaaagcgagtctgaatagggcgcatgagtacgtggtcgtagacccgaaaccaggtgatctacccatgtccagggtgaagttcaggtaacactgaatggaggcccgaacccacgcacgttgaaaagtgcggggatgaggtgtgggtaggggtgaaatgccaatcgaacctggagatagctggttctctccgaaatagctttagggctagcctcaaggtaagagtcttggaggtagagcactgattggactaggggcccctaccgggttaccgaattcagtcaaactccgaatgccaatgacttatccttgggagtcagactgcgagtgataagatccgtagtcgaaagggaaacagcccagaccgccagctaaggtcccaaagtatacgttaagtggaaaaggatgtggagttgcttagacaaccaggatgttggcttagaagcagccaccatttaaagagtgcgtaatagctcactggtcgagtgactctgcgccgaaaatgtaccggggctaaacgtatcaccgaagctgcggactgttcttcgaacagtggtaggagagcgttctaagggctgtgaagccagaccggaaggactggtggagcgcttagaagtgagaatgccggtatgagtagcgaaagaggggtgagaatcccctccaccgaatgcctaaggtttcctgaggaaggctcgtccgctcagggttagtcgggacctaagccgaggccgaaaggcgtaggcgatggacaacaggttgatattcctgtaccacctcctcaccatttgagcaatggggggacgcaggaggatagggtaagcgcggtattggatatccgcgtccaagcagttaggctgggaaataggcaaatccgtttcccataaggctgagctgtgatggcgagcgaaatatagtagcgaagttcctgattccacactgccaagaaaagcctctagcgaggtgagaggtgcccgtaccgcaaaccgacacaggtaggcgaggagagaatcctaaggtgatcgagagaactctcgttaaggaactcggcaaaatgaccccgtaacttcgggagaaggggtgctctgttagggtgcaagcccgagagagccgcagtgaataggcccaggcgactgtttagcaaaaacacaggtctctgcgaagccgtaaggcgaagtataggggctgacgcctgcccggtgctggaaggttaagaggagcgcttagcgtaagcgaaggtgcgaattgaagccccagtaaacggcggccgtaactataacggtcctaaggtagcgaaattccttgtcgggtaagttccgacccgcacgaaaggcgcaacgatctgggcactgtctcaacgagagactcggtgaaattatagtacctgtgaagatgcaggttacccgcgacaggacggaaagaccccgtggagctttactgcagcctgatattgaatgttggtacagcttgtacaggataggtaggagccttggaaaccggagcgccagcttcggtggaggcatcggtgggatactaccctggctgtattgaccttctaacccgccgcccttatcgggcggggagacagtgtcaggtgggcagtttgactggggcggtcgcctcctaaaaggtaacggaggcgcccaaaggttccctcagaatggttggaaatcattcgcagagtgtaaaggcacaagggagcttgactgcgagacctacaagtcgagcagggacgaaagtcgggcttagtgatccggtggttccgcatggaagggccatcgctcaacggataaaagctaccccggggataacaggcttatctcccccaagagtccacatcgacggggaggtttggcacctcgatgtcggctcatcgcatcctggggctgtagtcggtcccaagggttgggctgttcgcccattaaagcggtacgcgagctgggttcagaacgtcgtgagacagttcggtccctatccgtcgcgggcgcaggaaatttgagaggagctgtccttagtacgagaggaccgggatggacgcaccgctggtgtaccagttgttctgccaagggcatcgctgggtagctatgtgcggacgggataagtgctgaaagcatctaagcatgaagccccctcaagatgagatttcccattccgcaaggaagtaagatccctgaaagatgatcaggttgataggtctgaggtggaagtgtggcgacacatggagctgacagatactaatcgatcgaggacttaaccatatttttgaatgatgtcacacctgttatctagttttgagagaacactctcaatttgtttggtggcgatagcgaagaggtcacacccgttcccataccgaacacggaagttaagctcttcagcgccgatggtagtcgggggtttccccctgtgagagtaggacgccgccaagcaagcttaaacccagctcattgagctgggttttttgttttatatctctactgattttttttcttcggtacattttatcaagattctgctttttaagttttctaatactttcaatcccaatacaatccccagcatgatcaacatgagagtcataaataatcaaaatgcagtttgaacgggagactcatccagaatccatccgactgcaattggcagggtagtgccgccaatccattggcagcgagcagcatgcctgtcgtttgatctgtttttccatgataaaattgattggtgacaattaagataatggcgaacatgccggccataaataagtcctaagaaaaactaagaataatccctgcaaaagttgttttattgattgccaaaatacagagttaaatgaggccgctaatatttatcagcctgagataatgatgataggttatttttttggaaaccggctcgggttgccaaatgagagaaaagatattactgtcattaaaacgattcttggtttcatccggatatgataaaatgtctcagactatatttgagccatttttttcttcagcaatcatcttgcgtaattgataaaaatttattatgatactctttgtatgacaactccttgcctcaatacaatatactcaacgtttccccgttttccccggtcgtttttcttttcattttctcccgtaaaataaaaaagctcccaatacaatagatatggtgcggatttattttttactaaaaaggagtcgttatatttgaataatagttttacattaaaacagcaatggttcgggaatatccgaaaagacattcttgctggcattttagttgcgttagcgttaatacctgaagcgattggcttttctattatagccgatgtggatccgatggtcggtctttatgcgtcattttgtatcgccattattatttctatttttggcggcagacctggcatgatttcagctgcgacaggctcaatggcagtcgttatggtgtcgctggttgctgatcatgggcttcagtatttatttgcggctacgattttgacaggcattattcaggtgattttaggtatcagtaaaattgcaagattaatgaaattcatcccgcgttctgtgatgatcgggtttgtgaatgcgctggcgatccttatcttctctgcgcagcttccccagtttgaaggtgcttcttggagcatgtatgcgatgcttgccgggtcgttggttattatttatgtgctgccaaggtttacgactgctgttccgtctccgcttgtggcgattattgtgatgacaattattgcggtcactttccatgtggatgtgcggacggttggtgatatgggcaatatttctagttcattgcctcatttcttaatccctgatgttccgtttacctttgaaacactgcaaattatttttccttattcaattgctttagcgtttgtcgggttgcttgaatctttgctgacagcgcagattattgatgaaatgacggatacggacagtgataaaaataaagagagccgcggacagggaattgcgaatatcgtgactggattctttggcggaatggcaggctgcgctatgatcggacaatctgtcattaatacaaaagcgggcggtcgcggacgtttgtcagcatttgttgccggtgtttttctgatgtttttaattgcggtgttaagtcatgtcgtggtgaaaatcccaatggcggcgttagtggctgtaatggttatggtgtctgtcggcacttttgattggtcttctttaaaaggtctcaaaaaagcgccgctcacggactcgattgtcatggttgtgactgtggttacggttgttgtgacggatgacttatctaagggtgtatttgtcggtgttcttttaagtgccgtgttctttgtagcaaaaatctcgaagctgaaaatcgtttctcatgcagaggatcaaaagcttagaacgtatcaagtgaaggggcaaatcttttttgcgtcagtgactgatcttacgaatgcgtttatatatcaagaggatattgagcgggttgtgattgacttaactgaagctcacgtatgggacgattctggtgcggccgcacttgataagattgttgcgaagtttaaggaacaaggcattgaagctgagttaaaaggtttgaataaagcgagtaaatctctaatgaaacagatggcataaaatagagaagcccagatgaatgagatctgggcttttttatataacatacacttaagcagcattgatataatagagagaagagaaattttaaataggggacttgcatatgatgcttcagaagctgaaccgtgtattggggagagtgatgccgctgttaacgccgactagtgtggtgttgggcgtgctgctgtctcagtttttaaatgggtatgaatgggctgtgccttggatctttgcttttattacgtttgcaggcagtttgagcgcgaactttcaatctttgagacatgcattgtctcatcctctccctatgattcttgcactattcgttcttcatattttcatgccgctttttgcttggggcagcggccatcttatatttaaaggtgatcctttgacgattaccggtttaacattggctgttgtgattcctacggggattacaagcttgatttgggcagcgatgtacaaagggaatgtcggtttgacactttcgattattttagttgatactgtgctgtcaccgctaatcgtaccgctgagtctttcattgctggccggcgctcaggttcacatggatgtgtggggaatgatgaaaggtctgattgtaatggtcgtgattccttcttttttgggcatgctgtttaatcagatgtcatctccagaaagaactgcgtctgtgagcagtgcgctgtcgcctttttcaaagctttgtttgatggcagtgattgcgattaacagttcagcgattgctccttatttcaaatccattgatttgagatttgcaggaatagctgtaacggtattctttatcgcgttaacaggctatgccgctgcttggctgatcggaaaaatgatgaaaaggcggcaagaggaaatagtctctcttatatttacgggaggcatgaggaatattagtgccggcgcagttcttgccgttacgttcttcccgtctcaggttgccgttcctgttgtgatcggcatgctgtttcagcagatattggctgctttgtttggctatatgctgaatcgttttgaattaaaaccaatgttgcagaaagcataaaaaaaccgctcatagggttgagcggttttttccgtatagccattcgagcgcgttgatgaactgtttgcagaaatacttgcggtggtgcaccgctcctttttcaattgaaagacacaactggtcttcagtgaagcctttttcttttagactttgatgaacttgctttgtttttttcagcatatgtcgctgaatggattgtttttcacggccttcttcactcccgatagacatgaaaacacgtgcagtgccgggctttaaagaagatatatgaatggtttccgctgcgttctcgtaccagtatgaacctgatatagagcctattttcccgaacattgacggatattttaatatggcgaacattgagatgaggccgcctaatgaggcaccgatcattcctcttgactgcggttccctggtgacgttccagttttcttcgattagcggaatgaactggttcgttatatcagacagatagtgatatcccattccgccgaagtccgtgaaccgatcactgagtgatgcagccggccatggggtgtattcatcaagccggttttcgggttcgataccgatcagcacgagttcagggagcttttgctgttgaaatgcgctttctaataattcgatttggttttggaacaaagaactgccatcctgcacgtaaacagcaggaaatcccccgctgtctgtgctgtaggaaggagggaggtacagcgtgaacctcctgttgccggctttgtgttctgaaagagatcctttcaagcattctcccccttttttgcttgaaaagcagatataagaaataaggaactccgaggatcgccaaaatgatgcctgcgggcacttctgcgggctgaaaaaacagttttccagcaaagtctgcgcttatcacaagaagcatcccgattaaaccgctcagtggcaggatatagcgatgttcgacgccagccagtctccgtgagatatggggagcaattaagccgacaaacgccatacttcccgctacggagacacaggcgctgatgattgctacacaggctacgagcaggatggttttttctttatttgatgaaatgccgaggcttctgactgtgtcttcatcaaaacgaatggtgtcgagcaggcgggatttgccgataagaatcggtataaacagcagcatccatgggagaacggctgtgatatacgtccagttggcagaccagatgcttccgtttttccacaccatggccatttgatagtcttgcgggtccatttttaaagataaaaacaaagacagggcgctgaatcctgaattgatcgcaattcctaccagaataattcttcctgaatctaaattgcctctgtgccatgcaaatatgtaaatcaggatcgccgcgatgagcccgcctatcaatccaaagagcggcattcccatcgctgcagctatggatgtcacttccttctggccttggaataagagcataaacgctacaatgccggctcctgcccctgcgttgattccgagaattccagggtcagcaagcccgtttctcgtgatggcctggataacagcgcctgcaatgccaagaccgagtccaataatagcagccatgacaacccgcggcagtcttaaatcgaacaacaaaatttcatactgcggattcgggtcgatttgaaaaagagtggagagcagctcagcaggacgaacagaaaatgatccgctcgttaagctgaaatagctgacaacaagaatcaaagcgatgaacaatgcatattttttagccattttgctcccctccttttcgtttaattaaataaaggaagaaaggtacgccgataatggatgttacgacctcaatcggtgtttcaaacggatagttgataaatctgcttgcgagatcacacagggttaaaaagattccgcccaaaatacaggaacacggaatcagcctgctgtaatcagagccgacgagaaatctcgtgatatgcggaacaaccaacccgacaaacgcaatttttccggccagcgctacggcactgccggttagaatgatgacggaaagcatcgccatgattttaatggtttttttcttttgccccaggcttttagaaatgtcgtcccctaatgatacagcggttacctttttgctgagagaaatggccattataatgccagtcaggaaaaacggagcggcaagcttcaggaaatctggactcatttgatgaagtctggcactgtaccagaaactgagatcctgagaaatttgaaaataaatcgacatggccgctgataagctgctgagcagcatgcttgtgactgtgccgatgatggcgagctgcacgggggtaaatccgtttggcatcatggcggcaaggccgaatactaacaccgctcctaacgctgagccgataaaagagtatatcatcatttcaatcgaagatgattgcgggagcagaaccatgcaaagcgtaatgataaacgctgaaccatctgaaacacccataatggatggcgaagctaaataattgcgcgtaatgccctgcataagcgctccagaaacagcaagggctgcccctatgagcagagcgccggcagcccttggaatccgggaatgccatataatttgatggtctgtgtttcccggatcgaaatgaataagagatgtaaaaacaatatctgtgctgagatgctttgccccataaaggattgaaagcaaaagtgacagcgctatagcaaatggagaagtaatcaatatgatacgtgtccactgttttgaatacatacaaaaacctactctgaattagttttgtgtcaatttttcagcagccgctttcaggaaacggactttgctccaagctgtgccgccttgtgcgagagggtccactgagttgacatacacatgatcttctttgactgctttaaggcttttccagattggatttttctctaaatcttttaaggcatcaggtttgtctgcattttcatcatcagaaaattggacgaaaatatggtccgggttcatttcacttaatttttctaatgaaatcagctcttgcgcttttgcagcttttacttcgtttggcgccttaaggcctaaatcaccgtatagtgtggagttgaaatacacctgttcagggtaaatgtaaatgttgccttgtctgattctgatgacaagcgcttttgaatctttcgctttatcgttgatttttgtttttgtttcttttagatcctgttcatagtctgcaataattttctttgcttttttctcttttccagtcagctgggcaagcagcatcatgttttccttccagtttgaagagatatgagaaactgggatcgtcgtgcctgctgtgctgattttttgcagcgttttttccggaaactttgttgaagcaaggataacatctggcttcatttcaagaatcttttcaatatttggctccattttttctccggttggtttggctttatcagtgatgtctttgaacatatcagggaatttgccggagaatgaaattgcgccttgcggatgaacgtcaagcaatttcgcgtcttccattgattcaacgcttcccgtaatggcgattttgtctgtcggtacagttacttcatatgttttatcaagatattcaattttcttcttctcagatgctgtgccgcttgccttgctggcagttgatccatttttgctgccgcaagctgccgccgtcagcgcgagaagcaagattaataaggtaagagatatctttttcatctatagagcctcctgttcaattgataactattatcaattggaattatagagaatgaacagatataacaccatggacaaatttctgatttatcatggacaatctccggatagtaaagaaacagtttgctgaacaatgcgttcgtgcccgcaagctgagtattcattccacgggtcaagggatagaagataaacacggttatctcgtaccgcgcttaggttttgccatgcttctgtctgctgtaattgctggtagtaagctatggtctccggctctttaaaaagaaaaagcatcatacagtcagcttggtaatttgcgatattttctaacgaaatcgcttgttctgaaggtgtgtcagccgttgttgccgagctgaatcctaaatccccaaagaaaacttcgcggacacttcggttatgtgccagatagaagttttgcttatgcagcctcaaaaagagaaaacgcagcccttgaacgtgctgaagtgtttttttggcggctgttgtctgctggtcataatccgctagccacttttctgcttcggactcttcctttaaaaatgaggcagtttgcagaaagtgggttctccagctttcttctgaaggaaggtacatgacttctgcgatgcgattcaggcgatcttgttcttctggagaaatagaatccatgctgacaatcacatctggttctgcctgtgataacgtgtacaggttttcttcccacttttcattaaaccggtatgcactaagctggacgggtatatctgtcgaataatgctgatagtagtaagacgtccatttcggatgcagagcggccgcaaaaggtatgtggtgaagagggatgagatagcccattgtgccccttccgtatgcggcgattttctttcggcgttttttcatatagcttgtaggtgaacagcctgtatattttttgaagattctgctgaaataaaattcatcttgataaccggtttggtgtgcgatttctttcaatttgcagtttgattttgccatgagccgttttgcctttgtgattcgtgttttcgtaataaattctgttacgctctgtcctgtccattttttaaagctttcactgtagtgtttggcactgattcctgccatttgcgacagctgggcaagcgtgatttttgtatcggcatgggtttcgatatagtgttttgttttttcgattgctgaatgtgtatccgtttgatcagataaactggcagtaaaaagatcataaatcaggctttgtacttcaatcacacattttagctgagaaagctgagacgattcattccatagtgcggcaagctcttgaagccggactgcaagattttcgatatgtgaaacattcataagcttcagtttggctaattccgattctgtgcacggtgtgtaaatatcttggccggcttccttgatatagctttgaagcctgatcagacaggcatctatatgtccatcggctgctggcataaagccaaaggtctcgttaggcggacaaacataaagtgtctttttttgcagaggattggtgtttgttccgatcgaaatatagccgtttccttttaaatgaaaaatcagcacgaatgaatcggctaattgctgttctgagaagagatcacttgtcttttttagatattcaatttgtaccggttgataaatcactgcattttgcacgagtagaccaccttttcagaagctttcaattgataatcattttcaataaaaattgtaccaaataaatgaaagttttcctatataaagcgggtgggtttttagcatgaaaaaaacccttacttatgtgtaaaagtaagggtctttcgttcagtaagaatatgttacacgtgtaacatacgatgcttacgttctaataaatgagatatttttttcttgttttgctgaattgttggagtgttttttcatagctgtttatgatgtcctcaaccgaagttccattttcaatttttgtcctgatccagccgttgcctgccagtttatcgaatgaacctgttgacaggaactcaaaatcctcaggatagagatcgtgtatggttttaatgactgaaagacccgttttaacggcttcaaacttatctctgtctgtcacatagagctgcacaccgtggcaaagcgttccttgatgtttagaaaacgtcggtgtgaaggatgctgccctaaatgttacgcccggcaaatggaggctgtttaatgtttcttcaagttctgtgcttttgataaatggagctccgatcaattcgaatggttttgttgtccctcgcccttcggatatatttgttccttcaatcagcccggttgcaggataaacaaatgtgctttccaccgtcggcatgttaggcgaagggaggacgaaaggcaatcgggtatcgtcaaaatccatctttcgtttccagtgtttcatttttaccactgtaagatcggcatcaatactgaattctttgttgaacagtgaagccaattcgcctatcgtcatcccatgcttcaatggaatgggatacaatccgacaaatgaggcgtattcaggttctaaaattggtccttcaatatgattcccgccttgaggatttggacggtccagcaccataaatggaatgccgttttctttagcggcttccattgcgtatgccattgtataaatgtacgtgtagaaacgggtcccgacatcctgaatgtcaaacattagaatatcgacatttttcagcatttctggagtcggttttttcgtttttccgtagaggctgtatacgggaaccccggttttttcgtcaatgtaagagcctacttcgtctccagcctgggcgtcacctcggacgccgtgttcagggccgaataaagctgtcagtttgatatccgggttctcgtaaaggatatcgacactgcttttcagagatgcgtttactccggttggattggtgatcagtccgatacgttttcccttgagctgttttttatagtctggcaagagcgtgtctataccagtttggactttaggttttttagccgtttgattctttgaatcgggtgaagcagaggcagcggttatcgttccgaacatcatgagccctgtcagaaaagcgaatattgtttttctcatgtgtccctccttattaaagcggttttcccgttttgatatttaatccgtagccatatggataaagggtgtcccccgggttcgtgactgatgggatgttaactggaagtgtgcctttaggttttgcctggccgaaaatcgccatcactccggccggaatattaggttgaagataacggccatttgcgtatcctttaaagccatagactgcaatcagtgcctttgtttcttcgaaattggcggcatcatatgggttgcgcaggctcattaagacaaatggtttgttgtgctgcagtgcggctttcatgacagctctcggaaacacggtggcccatttgcttgaatctgatattgtgtcgtcgatgacaccatcgttgacgacagggtcatttttgacgacataggagccggttatgatataatcagccttttttacttgttttgcatgctcggcattaaatacttggttggcaaaattcattttgtcgacagatacgggtttgattttctttcgcttgatgagatcgtgaatggtttgttcgattgaagcagtttgttcttcgtaaggtgcaacaattaagatgtggctgccttttttaggcttgaacggcaaagtgtgctgttcattttttaatacggtcactgctttttcagctatttttttctctgctttgaggtgacgcttgcttcctacgattttttgggctttggctattttttcgtttgtactgtcgctgtttcgcgctggatacatgccgcgttttatttttagggaaatgattctttcaactgatttgttgatttgttgttcagggatatccccgtttttcacggcttctttcaaagcttgaataacacgtgcgaatttctgttcttctttcattgaagtgactgaggctggcattaatgcaatatcgacaccagcttttacggccatgaccacagcctcttcctgtccgaaatgatctgcgattgccttcatattgagcgcatcggtaacgatcacaccattaaagcccatttcctgacgaagaagacctgtcatcactttttttgaaagtgtagctggaaccagaatgtctgatccatcgagtttgcttttgtatgtggtgtcgtcgaaggcagggaattgaacatgggctgtcatcaccatatcagcaccggcatcaattgctttttggaaaggatagagttcgacctcccgaagccgttcttggccatgggaaacgagcggcagtccataatggctgtcaacgtccgtgtctccatgtcccgggaaatgtttgagggcagacgcgatatcctgccgctgcaaccctttcatcgtatatagaccgaggcgtgatgtcagttctcgattggagctgaatgaccgtacgccgattacaggattatcaggattattgttaatgtccacgacagggctgaaatctgtattgatgcctaaggcagagagctctttcccgatgatgctgccggtctgatacgcattgattctgcttctggctgcgcccagtgccatattccctgggaaattagtgccctcccctaaccgcgttacaatgccgccttcctgatcaatactcagcatgagcgggatttttggacttgccttttggtaatcgtctgtcagttggacagtttgttttgttgtttttacattttctgcaaaaaggatgatgcctccgaattgatatttcttgacgaggctggcgacttcatcattcatttctgtaagggcttgcggagaggactcgccttccttttgccaatttctaaaatcaggcatcagcatctggccgagtttttcatctaacgacatacgattgacaatctgattggcatcgattgaacgtttggatgcagaggcttctgtctgtctggccccgaaaaagcatgaaagaaagagaacggctgaaaggataagcggaaagacaggtctcatagaaacttcctcctatcgtctaatcattcactccatcgcttcataaatcgcggttatgacacttccataactgcctgttgcaaattgatcaccctcaaagacgtttggattttcttctggatcaataactggtgtatgctttttatttgttaacaatgcgatgcctaaattgtatgctggatcaataattgtaactgtccctgtccagccggtatgcccgtaagcattttcactggcatgagggccaaacatccattccatgcttttacttccgttccgcctccagccaagagcgaatgtcgggtctgttgctgaaggtgctgtaaacaggtcggctgttttctgatcaaataaagaaatgtttcggtatgaacctttgtttaacatgacttgcagcagtatggccatatcatctgcatttgagaacaatccggcatgcccagacacgccatccattgagtaaaacgctttttcgtcatgcacctctccttgcagcgtgtttgtgcggatgttagggaattgaataacgccgtcacgtgtattgcccattcgttcagtagctgcgaactgtttcggtttaaagcccttttgcagcggattgtacaaggtatgcttcagcctgagcggtttgtagagctcttgctccgtgtagacatcaagcggtttgccagtgagtttttcgacaatacacccaagtagcatatatccaatgtcactgtatacgtgctttgtcccggtttgataatcgagcggaattttcgtcaaatattcaatcgttttgtcccgttcttggaatagtacttgccggctttttccggcgtgtaaaagtaaaagcttgatgggagccctgattggtgctggaggacatcaatgacacgtatcttgtcttttccttttatgaggtcacccggctgatccttgaaacccggcaaatatgcagaaactttttcatagacgtcaagttttccttggctgactaagcgctgcaatgcaaaatttgttgcgtacatttttgtatttgaggctaagtcaaacatcgtgcgggttttcattttggccggacggcgcagcagttctgacccttcgtactttttactgtagccgtatgcttctttttttatgatgcgtccatccttcaccaccacaagaacggcgcctggaaatcctgctgcaatatcccgttctatcatctgatctaccttccttagcttcttcgtcgagaattgtgcagtttctgcatttatggttttcggctcaaccaagttgtctgctgtttgtgcgaaggtttcatttggcgcgaatatcgatagggttaaaatggcactgaatatgaacagtgtctttgttttcacaggctagcccctttctgtgcttctatcccgtttactatccctaaaacagaaccatttaatcgaactgagaagccatttcatctttatatccgaatgcataggtcaataaaaaaccggccgcataggaaataaagagcccaacgatatacaggatgatttgcgaaggcaggactagaaaggaaagcggcagtccggagacaccaatcgcaatggtggctacttgaaaatacgcttgaaaggcaccaccgattccagctcctaaacatgctgttaaaaacggacggccaagcggcagcgtgactccgaaaataagcggttcaccaatgccgagcagtcccgatggaagcccgccggcgattgctttcctcagtgttgtttttttcgtcttcatgaaaacggcaaaggccgcgcctacctgtcctgcacctcccatagccaaaatagggagcagaggatcattgccaattgaattgatcagttccatgtgcacaggcgtcaagccttgatgcagtccggttacgacgagaggaaggaaggttgcgcccagaataaagcctgcagcgatgccgccgatgtccaggatggacagaaggccggatgtaatggcatcagaaatgaatccgcctaaaggcataaatacgacatacgttacgattccggtgattaacagtgaaacggtgggtgtgacaatgatatcgagtgattgaggaataaaccggcgaataaattgttcggtgtaagcaatgaatatggctgcgaaaaggacgccgatcagacctcccctgcccgggagaagctcttctccaaataaactgatttttgcgatctccggattgataatcaagatcccggccaaagccccaagtgcgggtgtcccgccaaattctttcgaagcgttaataccgacgagaatgccgagataagtgaacagccctgatccgatgactgtcaggataaccgcaatttgtgagtctgcagagagccagcctgcttgaataattgctttggtaatcccagtaattaaaccggaagcgactagagcgggaataagagggatgaaaatgctggcaattttacgtaagaaaagtttaaaaggagtggcgttttttcgattgatatcggctttctttttggccgcagcttctttgacatcggcaccttcttctgctgacacgagctttgagaaagcagctgtaacatgattgacgactcctgtgccgaggataatttgtaaggtttcagcttcaacgacccccaatacgccgtcaagctttcttaaaccctgagcatctgctttgctttcatcgtaaggcgtaatgcgcaggcgtgtcatgcaatgcgtatatgaagaaatattggattttcctccgcatagctcaaggattttctgtgcgagatgatggtagttattttctttgctcattaaaacccctccccttcaagatgccttattttattctcatagattgtatggctgctctcgttttatcgatataaccggttgtcgtttcatactgctcagccgccatgcctaaaaacaaaacatcaattataaaaagctgggcgaggcgggaggaagtggctgcacttcgaatcaaggcttcattggaatgggctgtatacaaagggacatcagccagtgcggagacggatgtctgactgaattgtgtgaggctgatcgttgtgatgcctttttccttggccatggcaaacagttcaatgatttcctgtgtctctcctgaaaacgaaatggcgaatacgatgtcgtctttatctgcatttgcgattaaagatgccacaagatgagtgtctgtaaacgcggttgcttgtttatgaatgcgaagccacttttgctgggcgtccttggcgacaatgccggaagccccgaggccgataaaatgcacggtatgagctttgagaagcagagaaaccgctcgttcaagctctttgtagtccatcaggtctgaagtatcctgaatggcttgaatggcattgccggccgttttttcggaaatggagggcagcggctcgtggggaacaatatcccggtagccctgaaacgtaggctttgccagatcgcccgctactctcatttttaaatcttgaaatccttttaaaccgagtgatttgcagagcctgatgacggcagcgtcacttgaattggctaaggcgctgatttcgttgaccgtgctttcgattgctttgtggggatgggctaggatataatctgcaagtttgcgctcggatggagggagcttatgcttcattgattggatgatcgctaaaccgcctgtggccattctagttctctccttatcatggatggtaatgttcgattgctttgtcaatgaaaccgtttgcttcatcgagtaatgtctttgcttgtttctgatctgtgcttgttttgagcatgacgattgctgttttgacgtgatgatcggcttgttccagagtgtatctggctgtgtcgtatgaagcgtttgtaaggctttggataatgctgatggcgcgttcttttagttttttgttgctgacgttgacgtctaccatcaagttttcgtaaaccttgccgattttgaccattacagcggtagatatcatgtttagaatcattttatgagcggttgcggctttcatacgtgttgatcctgtaatggcctcaggtccgacgacaacctcaatgctgtgatccgcatccttgctgatggcggaattttcattgcaagtaagggcgatggtgtgtgctccgactttgcgggcgtatcttagggcgcctgcggcgtacggtgtgcggccgcttgctgcgatggcaatgacggtgtcatttgaagtgagctgtatgtttcttaaatcttcagctcctgcttcttcactgtcttcaatgccctctgctgcctgtaaaaaggctttggggcctccagccatgattccgatgacctgatctgggcttacgctgtaggtgggaggacattcaacagcatccatgacgccgagtctgccacttgtgccggcgcctgtatatatgagccggcctccattttgaaacgattcatatgcgcagtctacagctgttttgatgtcggggagaacctcctgaacggctgcagcgactttcatatcttcgttgttgatcattttgaggatgccgagagtgtttgctttgtggatttcaactgtttggctattgcgtgattccgttgtaagacggtgaaggtttaatggttctgacatgaggatgccccctgttttaaaatgatatatctcaatattcagtatattcatctctgttatgatatttcaactatgtttttaaatttttgaaattttatttcactcaagactataagaaatgatgaaggatcaactgttctccaagcgggccgattcttcgccgtcctttatcaaggaacccgcttttcatataaaggtgttttgcgcgtatgttcagatgattgacggccaagatgatttcgtcgcaccatggaaaatatccgctcacaaaagcgggaagcaaaagcatggcttttttcgcatagccttttccgtgatgcacagcgtttaaagacagggagctgagcagtaaagcaaatggattgttagaataagaagcaagcgtttcttttgatgcatgtaaaatgaaaaaaccgactggaaggtcgtcttttaagatgacaaccgggtatcggtcctgtatgcccagagcctgagacagcacctctttcgggagggaggtaaagcgtttgtcatcgttggtgagcgtgaatgattggagctcgggcaagtgttcaggcttatagaaggataaagaaatgtcttgagtcatggggtggcctccttacaatatgtcgttaagctcgttttccgaaatgacgcggtagcccgcttgttttaacagtgcggcggttactccgctgccggtgatttttttgccagagaatgtgccgttatagataaaaccgcttccgcaagatggactgttttcttttaatatgacggcagaagcgttgatttcttttgcgtaagccaatgttttcgcggcgccttccatatatagttctgtgacgtcttctcctgaagctgtcacgattttcgctgttccattgaggacatcctcgccggtgcctcctatgatttctgcgggttcgcgtggggtagagaagccgccgagaagttcagggcaagccataactgctttcttttcatcgacgagttttctgattttctccgacgctgcgtgagagccgttatatctgcattcaatgcctccaaggcaggaactgactagaatcatattgtttctcctctcttgctttgcttgtctctatcataaaataaatggctttagttgggaggctttttcagttaaaaaaggagttaaaaagtttgaaaataaaaaatttaattttcctctttacaaacagggggtgacctgtatataataacttttgtcagctcgacgagaacacaacggcccgttggtcaagcggttaagacaccgccctttcacggcggtaacacgggttcgaatcccgtacgggtcaccatttggaggattagctcagctgggagagcatctgccttacaagcagagggtcggcggttcgagcccgtcatcctccaccatcttgccggtgtagctcaattggtagagcaactgacttgtaatcagtaggttgggggttcaagtcctcttgccggcactgttttttcaaaattttatgtggaggggtagcgaagtggctaaacgcggcggactgtaaatccgctccctcagggttcggcagttcgaatctgcccccctccaccattattgggctatagccaagcggtaaggcaacggactttgactccgtcatgcgttggttcgaatccagctagcccagtcacagacacctttgatcaaaaggtgtcttttttcttttcgggaaaatcattccaacttctaactgttcagtctgtataataattttaaaaatatgttaaggtagtttattcacgaattaccatctacaccctgccaaaaatttgataaacttattttataaaaaaattgaaaccttttgaaacgaagctcgtatacatacagaccggtgaaggcagaggttagataaatatggaaatgatgattaaaaaaagaattaaacaagtcaaaaaaggcgaccagaatgcatttgcggacatcgtagatatttacaaagataaaatttatcagctttgctaccgtatgcttggcaatgtgcatgaggcggaggatattgcacaggaagctttcatcagagcgtacgttaatatcgacagttttgatattaaccggaaattttcaacttggctttatcgaatcgcgaccaatttgaccattgaccgcattcgcaaaaagaagccggattattacctcgatgcagaggtggctggtacggaaggcttgaccatgtattctcaaatcgccgcagatggtgttttgcctgaagatgcagttgtgtcgctggagctctcaaacacgatacagcagaaaattttaaagcttcctgacaaatacagaacagtcatcgtattaaagtatattgacgaactctcattaattgaaatcggggagattctaaacattcctgtggggactgtgaaaacgcggattcacagaggcagagaggctcttagaaaacaattaagggatctttaagtggggtgatgaaatgagctgtcctgaacaaattgtgcagcttatgcatatgcatcttgatggagatatccttccaaaagatgaacacgtattaaatgaacatctggagacatgcgagaaatgcagaaagcatttttacgagatggagaaatccatagcgcttgtacggagcacatcgcatgtcgaagcccccgcggattttaccgctaatgtcatggcaaaattgcctaaggagaagaaaagagcttctgtaaaaagatggttcagaacccatcccgttatcgcagctgctgcggtattcatcattttgatgggcgggggtttttttaacagctggcataatgaccacaatttcagcgtgtccaagcagccgaatcttgtggttcataaccatactgtgaccgtaccagaaggtgagacggtcaaaggtgatgtcactgtcaaaaacggcaagctgattattaaaggcaaaatagacggggatgtaaccgtcgtaaacggcgaaaagtatatggcctctgctggacaagtcaccggtcagattgaagaaatcaatcaattattcgactggacatggtacaagatgaagtctgcggggaaaagtgtactcgatgcattcaatccgaacggagaagagtaaagcgcgttagccgctttgctctttttttgcgggctgagagcgctggcacatttcacttgctaaatcgaaatgtggtataatgggctcgctatgtaaagtacatatgcgtaacacgtaaaacacaaaatacgaaatgactgaaatcttggaggacgaggaaatggcttttgaggatatcccttttttgcagtacctcggcaatgccgttgatattctccttgtttggtatgtgatatataaattgattatggtgatacgcggcacgaaagcggttcagctgttaaaaggaattgtagtcatcgtgcttgttcgtatggccagccaatatttgggcctcagcacacttcaatggctgatggaccaagcgataacatggggatttttagcaattattattatttttcagcctgagctgagaagagcgcttgaacagctaggccgcggccgctttttttcgaggagcggcacgcctgttgaagaagcgcagcagaaaacgattgaggccattacaaaagcgatcaattatatggcgaaacgccgtataggcgccttgcttaccattgagcgggatactggaatgggggattatattgagaccggcataccactgaatgccaaagtcagctctgagctgctgatcaatatttttatcccaaacaccccgcttcatgacggtgcggtgattatgaaaaataatgaaattgccgcggccgcctgttatctgccgctttctgagagcccgtttatttcaaaagaactgggcacgcggcacagagcggctgtcggtatcagtgaagtaacagacagtttgacgattattgtgtctgaagagaccggcggcgtcagtgtggcaaggaacggcgaccttcacagagagctaacagaagaagcgctgaaagaaatgcttgaagccgagtttaagaaaaacaccagagacacttcttctaaccgctggtattggaggggcaagaaaaatggataaattcttaaacaaccgctgggctgtgaaaatcattgctctgcttttcgcgctcttgctttatgtggcggttaacagcaaccaagcaccgactccaaaaaaaccgggtgaatctttctttccgacatcaacaactgatgaagcaactctgactgatatcccggttaaagcgtattatgatgatgaaaattacgtcgtgacgggtgttccgcaaacggttaatgtcacgataaaaggctcgacaagcgccgtgaaaaaggctcggcagaccaagaactttgaaatatatgccgatatggaacatttgaaaaccggcacgcataaggttgagcttaaggccaaaaacgtgtcggatgggctgacaatctcaattaatccgtctgttacgacagtgaccattcaggaacggacgaccaaaagttttcccgtagaagtggagtactacaacaaaagcaagatgaaaaaaggctattctccggagcagccgattgtcagtccgaaaaatgtgcagattaccggatcgaaaaatgtcatcgataatatttctcttgtaaaagcttcagtgaatttggaaaacgcagatgaaacgattgaaaaggaagcgaaagtgactgtctatgataaagacggaaacgcgcttcctgtcgacgtggagccctcggtcatcaagattaccgttccggtgacaagcccgagtaaaaaagtgccctttaaaattgaacggacaggaagccttcctgacggtgtcagcatagcgaatattgaatccagccccagtgaggtaacggtttacggctcacaggatgtgttggattctcttgaatttattgacggcgtcagcttagatttaagtaaaattaacaaggattccgatatcgaggcagatattccgcttcctgacggtgtcaaaaaaatctcaccgtcaaaggtgactttgcatatagaagtcgatagtgaagcggatcagaagttcgagaatgtccctatcaagactgtagggctgagcagctcacaaaacattgaatttcttgatcctgaatcacaagctatagatgtaacggctaaaggctctcccgcgaatataaaaaaactgaaaaaatcagatattgaattgtatgtgaatgtttcagatttagaggacggggagcatagcgtgaagcttgaagtgaacgggccacagaatgtaacttggtccttggggcggaaaaacgccaaaatcaagctgacgtctaagaaaagcaatacatcaacgaatgataacagcagcaatacatcagggaaccaggatgacacagataaacaaacaaatgatcaaaagaacaatcagcaagaagatacaaagaacactgataaaaacaacaacgatcaaaaccaagacgaaaataaagatcaaaaccaagatcaggatgaggatgaatccactgcgaattcacaatcctcatcggaataaaaaaggagcgattataaaatgggcaagtattttggaacagacggtgtaagaggtgtcgccaatagtgagcttacacctgagctggcctttaaagtcggacgtttcggcggttatgtgctgacaaaagacaaacaacgtccaaaagtgctgataggccgcgatacacgcatctccggccatatgctggagggagcccttgtcgccggacttttatccattggcgcagaagtcatgcgcctgggtgtcatttctacaccaggtgtatcttatttgacaaaagcgatggatgcagaggcgggcgtcatgatttccgcttctcataacccagtgcaggataacggcatcaaattctttgggggagatggatttaagctttctgatgaacaagaggctgaaattgagcgcctgatggacgaacctgaggataagctgccaagacctgtcggagcagaccttggacttgtaaacgattattttgaaggcggacaaaaatatctgcaattcttaaaacagacagctgatgaagatttcacaggcattcatgtggcattggactgtgcccatggcgcaacgtcatccttggcgacacacctgtttgctgatttagatgcagatgtttctacaatggggacttccccgaacggattaaacattaatgacggcgtcggttcgactcatcccgaagcgctcagcgcgtttgtcaaagagaaaaacgcggatcttggtcttgcgttcgacggtgacggcgaccgcctgattgctgtcgatgaaaaaggaaatattgtagacggcgaccaaatcatgtacatatgctcaaaacatctgaaatcagagggccgtttaaaggatgatactttggtttcaaccgtgatgagcaacctcggcttctataaggcgctcgaaaaagaaggcatcaaaagcgtacagacagctgtcggcgaccgctacgtagtagaagcaatgaaaaaagacggctacaacgtcggcggagagcagtcaggacatcttattttccttgattacaacacgacaggggacggattattgtctgctattatgctgatgaacactttgaaagccacaggcaagccactgtcagagcttgcagctgaaatgcagaagttcccgcagctgttagtcaatgtgagagtgactgataaatataaagttgaagaaaatgaaaaagtaaaagcagttatttctgaagttgaaaaagaaatgaacggcgacggccggattttggtgcgcccttcaggaactgaaccgctcgtccgtgtcatggctgaagcgaagacgaaagagctgtgcgatgagtatgtcaatcgcattgttgaagtcgtccggtcagaaatgggattagagtaacgaagtctattatcagagagtgaacaagacaagcgaggattacataagataattgtgagacatacggcaaagttgtttaaaaaacaattgaccgtttatgccacatgttgtaaaatcaagcttgtcttgttcttattttctcaataggaaaagaagacgggattattgctttacctataattatagcgcccgaactaagcgcccggaaaaaggcttagttgacgaggatggaggttatcgaattttcggcggatgcctcccggctgagtgtgcagatcacagccgtaaggatttcttcaaaccaagggggtgactccttgaacaaagagaaatcacatgatcttccaaaaaacatgtaggaggggacgattgaaagtccccttgaaatttgactttcttcgtctccttttacaatcttaggaggaagaaaaatatgtgtggaatcgtaggttatatcggtcagcttgatgcgaaggaaattttattaaaagggttagagaagcttgagtatcgcggttatgactctgctggtattgctgttgccaacgaacagggaatccatgtgttcaaagaaaaaggacgcattgcagatcttcgtgaagttgtggatgccaatgtagaggcgaaagccggaattgggcatactcgctgggctacacacggcgaaccaagctatctgaacgctcacccgcatcaaagcgcactgggccgctttacacttgttcataacggcgtgatcgagaactatgttcagctcaagcaagagtatttgcaagatgtagagctcaaaagtgacaccgatacagaagtagtcgttcaagtaatcgagcaattcgtcaatggaggacttgagacagaagaagcgttccgtaaaacacttacactgttaaaaggctcttatgcaattgctttattcgataacgacaacagagaaacgatttttgtagcgaaaaacaaaagccctctattagtaggtcttggagatacattcaacgtcgtagcatctgatgcaatggcgatgcttcaagtaaccaacgaatatgttgagctgatggataaagaaatggttatcgtcactgatgaccaagttgtcatcaaaaaccttgatggtgacgtgattacacgtgcgtcttatattgctgagcttgatgccagtgatatcgaaaaaggcacataccctcactacatgttgaaagaaacggatgagcagcctgttgttatgcgcaaaattatccaaacgtatcaagatgaaaacggcaagctgtctgtgcctggtgatatcgctgccgctgtagcggaagcggaccgcatctatatcattggctgcggaacaagctaccatgcaggacttgtcggtaaacaatatattgaaatgtgggcaaacgtgccggttgaagtgcatgtagcgagtgaattctcctacaacatgccgcttctgtctaagaaaccgctcttcattttcctttctcaaagcggagaaacagcagacagccgcgcggttctcgttcaagtcaaagcactcggacacaaagccctgacaatcacaaacgtacctggatcaacgctttctcgtgaagctgactatacattgctgcttcatgcaggccctgagatcgctgttgcgtcaacgaaagcatacactgcacaaattgcagttcttgcggttcttgcttctgtggctgctgacaaaaacggcatcgatatcggatttgacctcgtcaaagaactcggtatcgctgcaaacgcaatggaagctctatgcgaccagaaagacgaaatggaaatgatcgcccgtgaatacctgactgtatccagaaacgctttcttcatcggacgcggccttgactacttcgtatgtgtcgaaggcgcactgaagctgaaagagatttcttacatccaggcagaaggttttgccggcggtgagctaaagcacggaacgattgccttgatcgaacaaggaacaccagtattcgcactggcaactcaagagcacgtaaacctaagcatccgcggaaacgtcaaagaagttgccgctcgcggagcaaacacatgcatcatctcactaaaaggcctagacgatgcggatgacagattcgtactgccggaagtaaacccagcgcttgctccgttggtatctgttgttccattgcagctgatcgcttactatgctgcactgcatcgcggctgtgatgttgataaaccgcgtaaccttgcgaagagtgttactgtggagtaataaatgtttaacccctttggataagattgtctaaaggggtgtttttatgtccaaaagagaaagaacgtctacagtggaaaaatggattaaagaaggtgattgtacaggactcgactatcgatcggccatggctatagatttaagatgtttcctcataaggccagttaacgagcttaaaaggctttaaaactagtagactgcatgaatttttcagtggagcgaaactgcttttactttcacctgaattttcttatgtaatagcagaccggagagcctattgtaatgacaacagattttttatgacatttaataaggggcgagaaattcatgacattaaaatgaaagatgaaaagagaatgtacttgtgggccttaggttttaaaattcattcttttgttattgagtacattccggtttaagttgaaatgattcagtaaaggacacgccataaataaaaggtagcgtatgattgccattctttccatggaaccgatatttctaagatttcatctttcgtaggctttcggttcatattacgtaatatttttatcgaatgaataagacccacatcatcgattggaaaagctgtcgggaacctaaggcagcgcattagaacataattggctgtccaaggaccgattcctcgtattttaattaagtttttttcagcatctttaaagttcattttcattaatttttccctcgataattctccacttgccattaatctggctattccaatgatatattcacttttttttaccgtcattttaatatctgccaggtcggtaggggttaaccgtgcaattcgttcgtacggtgggaacacccaatactttttaccattccattcaatagaatcgccaaatgcttctacaaattgcttctttaaggagtacgcgaaggctaagttaatttgttgtcctaaaactccccaacataaagcttcaaataaatcgggaatgccgataactcgcaacccataaaattttcgggcaggcattttaagtaatggatctgcttttgccatttcataaaatggtgttaaatcgttatcaagatcaaaccattcatgaatatattttacaatctcttcccgtttccactgctcaacaggtctagaatcgtttaggaattgaacaaccatttgtttattattgattacgcttacctgcactaaggaccgaatttccccattggctataacttttgtaatgatattgttctctatttcatacatgcattcatttttttctctggttagatagcctaggttcgcattcatgtcgaaaatttcaggtaatgtaatgacaataacatcattgacttcatgccatgtcactttttcattctccttatcttaaataattataagaaaactcacgctggttgaaattagtttatcacataatcatctttactcattttgttatcttgctattacattctaaccaccttatttttttctatttatgaggttatagtgtagttatcaagaatgctaaacgggagtagataaaaatggcccaagatataaaaaacgcgtgtcgaaaatttaaattgggattcaattcaaactgaattagatgagcattgtaaggagaggtgagataaatgccggatagtatcaataacggacataaagagagccatgagcatagaatttcgaatgatgtagaaatgataacagatgaaaagtggcaagcaattataaataatgatgcagcgtacaataatcaatttttctacgctgtaaaatcgacagggatattctgtaaaccatcctgtaaatctcgcgttccgaaaaaagaaaatgtatgtatttttccaaacgcagaacaagctctccgcgcaaattttcgcccttgtaaacgttgcaagcccactaatgaaaaaatgcctgatagcgagtgggttgatctaattactgaatacattgataaaaatttcacagaaaaattaacgctagaatcgttagcagatatttgtcatgggagtccgtatcatatgcatcgaacatttaaaaagattaaaggcattacgctggttgagtatatacaacaagttagagtacacgcggctaaaaagtatttgattcagacaaataaatcgattggagatatcgctatatgtgtgggtatagctaacgcgccttattttattactttatttaaaaagaaaactggacagacaccagcacaatttcgtcaaatgagtaaaatggaggaaacgtacaatggaaacaaataaaccaaccctttattggtctttactaatgttcaaggagtggaatttttatattgcttcaactttaaaggggcttgtgtttgtaggttcacagaacaaaccaatcgaggaattgttcgaatgggctaggaaacgctttccgggaagtcttcttgttgaagatgatgataagcttgaaccctatgccgttgaaatcactcaatatctagaaggaaagcggaaaaactttactgttccagttgagtacgccggtacgcaatttcagctagcagtctggaatgcactttgtgaaattccttatggacagacgaaatcctattccgacattgcaaatgaaataaataaaccagcagctgttcgtgctgtaggtgcggctattggggctaatccggtattaattactgtaccgtgccatcgtgtaataggaaagaatggctcattaactggctatcggggcggattcgaaatgaagacactgctcctcgatctggaaaagcgagcttcatctgaaatggatgttcctcattgaaagtgaatcatctataatgggttggattcttttagaggaaagtaaagaccagtttactgataaacttgacaacttttaaaatttagcatatcttatacgtaacttaataatcgatgcagatgtttatttttccttttaaaatatgtaggcctttagcattcttttcatatttaattttaaatattgataggatgaaaaagtatcctaataaaaaaggaagagaacatgagtcgatttatttgataatcagggctatattaaaggaaatgaaaacatagcataaagtaaagaccaataataaggtagcacttcaaaaaacttcgctgaagttagttgaagtgaagccgacaattttcaggattcaatgatctaacataatcattgaaattttgaagttgtcggcttttttgttggaaaaaaatagagataaataaaaattgaaataaataatagacaaatatgatctgattgaaaggtcttttgaccaataatgagttttaaaaaagggagaatttagaatgttagtttcgctgagtttgtcatcattattaacattattttttattatgcttatggcttctgggattagtggactattgtttttacatccgcgagtacccttgagttttgttcgcattcatattgggatcttggctttaccacttttggtttccttactgattcttgccaatagtggtgtgagtggaaatgttggcccttggcacttagattccttagcttgtttaatgactttctttgttcttgcaattggattcatcattcagcgtttttctgtacgttacttaatgggggatcgatcttatcgaaaatattttgcgctttttactttcacaacaggtactgcttcaatgacatggttaagtggcgatctccgcttgatggttctattttggggagcaactcttgttggtttaaccttacttattaggttaaacagtgcttggcaagtggctagtgaagcagccaaaatttctggccggttatttttgttaagttggttttctttgttttttgcgatgatgtggctttttcatgccacaggtcaatggcagttatcattggttgtaacaaatgaaagtttagctgggctgggagaatgggagagaacagggattcagctattgattgtattagcagtgattattcctgcagctcaatggccgttccaaagatggttggttgagtctattgttgctccaaccccagtttctgcaattatgcatgcaggtttagtaaatgctggaggaataatactaactcgattttcacctctatttcatggtggtatcgcttcgattatcttacttctgcttgctggcatttctgtattgattggaactggaattagtttagtccaggttgattataaacgccagttagtaggctccacgattggacaaatggggtttatgctcattcagtgtgcattaggcgcctatatagcagccattattcatcttattttacatggtttattcaaagctacgttgtttctacaagctggttcagcagtagggcgtcatgaagtatcggctcgcactaatgaaagaacatcctatttatgggccatggctggtcggattttatccttagttataggtgttgctttttggctcactgctcctggggacgggtatcacttaatcagtgcgctgatcttagggtggtcattgtccgtttcttggactcagcttgtcgcttttggagagggccgaattggccgaattgctggcttaactgttttaggaggagcagccctcgtatattttatcattcataaccttttctataagtggctgcatacaaccatttttcaaagtgttcaacctccaatgtcagctgtcatgattgtcgtatgtctcttactctttggcagtgctttaggtacgtgggttgctcgtcatcgttcttccgtttttttcgcggtactctatctttggttagtccgattaggtgaagcaaaaccaaagtcagtagagagtcacccagactaccttaaacaatatatttcataaggagctaatctgagatgggcattacatccgtattaacgaaagataatgtaaaaaagatagatacagatattgatgttcaagaaggggatcttaacgttttcattacatctgccagccgagtgattgcgccactttggcctatttctacatttgctgcacgtaatccgtggatgggacttgaaaaccaaccttttgatcaggttgcaagttggttgaaaaacactcgcgatgttgatatataccctagtgcgtctatgatccgttcagcaaagaataaaggtgagattgatgaagattttgtggaaatggggctgcagcgttggcttgattcacattcctatcacatcccacgggacgtagcagagcgattttgtcatgctgcattaaagttagatcccctgccttccgaccttttatcatcacatgagctggagaaattagtaggtgaatgtagtggattggatcatatcgagaatgtgtttatgcagccactaagttcgtatatagagaatcaagatggtgaaaggctagtcaatatactagatcatcatgtcattaagtggagtaaattatatcttgatgactctcaagcaggctggacaatgcctaatcgtgaggaaggtttctatcgtgcttggcagcatctcattcaatatgatccagcacttagcaaaaagcagcgagaaagggtaaaggattggccgaaagaggcacatttggctttacaggaagccttattcgcactagaaatcccagagtcagaaatccagacttatcttgaaggtcatttactttcattacctggatgggcagggatgatgctttggcgctcccagcaatcgagccacgaacatgcactcctaacagaatatttagcggttcgaatatccatggagtgggctcttataaagccatacttacctttgactaatgaacgatctaagaaaacaatttcaattgctccccttatagcagcttggattcattggggtgggcttacattagaagaatggtcacagatgacggccattgaacaaaacgaatatttatcatttgcctacagctttgatgagaaacttcgcaagaaactttggttagaagcttgggaacaaacgtacactgatcgattaagccagaagatcatctcgaaacaacgtgaaaccggcggtgaaaaatctgcattagctcaattagcattctgcatcgatgtacgatcagaaccttttcgtcgtcaactagaaaaagaaggcccgtttgaaacgattggtattgctggtttcttcggggtgccgattgcaacttgtgaacttggcagtaaacacagtcatgcttcgttaccgatcatacaaaaaccgcaaaataaaataaaagagttcgcagatgaggatgtattcaaaaaatacaatcaacggaagcaagcaattcattctttaagccatacctttaaaacgatgaagcagaatgcgctttcgagcttactactgcctgagctaagcggaccttggctaactctgcaaatggcagcccgtagctttgtgccaagaaaggcaggtcgtttcattcgtaatctccgtgaggcttggttacgcaaacctgatacaaaactctcgcttcatcatgatgctacagaggcagaaatacctgtgggttttactgatgaagaaaaagtgaactatgctcgccaagcattaaaaatgatggggttaacagagaacatcgcaccattggtcgtaatttgcgggcatggcagtcaaagcactaataatccttattctgcagcccttgattgtggtgcctgcggtggagcggccggtggattcaatgcaagagttttagctgctttatgtaatctatcagaggtacgagaagctcttttagctgaaggaattaaaattcctgaggatacggtttttgcagcagctgaacataatacaacagtagatgaattacattggctttatgtaccagagctttccgaagctgcacaagaagcatttgaacaaattgaagccgttatgccgaaagtgagacatcatgtaaacgcagaacgtctagcccaattaccgaatttccaatcgaagctaaaaaatccgaaggctgaggcaaaccgatttgcggaagattggagtgagatacgtccggaatggggactggctcgtaatgccgcttttattatcggtaaacgtgaactaactcaggattgtgatttggaaggcagagcctttctccataattatgattggaagcaggatgaaagcggtgaactcctagcaaatattattgcaggacctggaactgtagcccaatggattaatttacaatattacgcatcaacggtagcacctcattattatggcagcggaaataaagcaactcaaaccgttactgcaggtctcggcgttatgcaggggaatgcaagcgatttgttagccggactgccttggcaatccgtcatggaatcagatcacgaggcctatcattctcctcttcgtttattgatactcatccaagcacctagagaatatgtagaacggttattaaataatgattcagcatttctgcaaaaagttcaaaatggatgggtccgactggctagtcttgatccagaaggatgttgggaaagctggtaatgatgaatctaagcatttatcaaatggatttgttattcaaaataaaaatgataaacataaggaagaggtgtgctgtatgaatgtaaaccaaaataaaaaagtattatttttgacggatattgaaaacggtttggagcctattttacaagaagcgactaacacttctgcagagaatatgttgactatacaaagctatggtgccagtatttcacatccttatggagaaatcatgaggtctgttatttttgcgatttatcaggaagatgttgaggagatttttgtagtaggaacaaaagataagaagacttccgcaggtaatggactaactcaacttgaaacaatgaaagataaaatacaaacattggattatctctttcaaaattgcaagcctgaatttttaggtggtacggtcgatgaatggctaaatgaaaatagcagtgacaccattgaaaaaagtgttgatatgattcgacatcatccactagtgccgtcacatgttaaagttcgaggtttacttgttaatcataaggatggaaaaccctcaattatggagggtcctgatgctaaaacaggtcaagccatacctgatcattgcttgtcatgatgaaatgcaggttcaacttctaaacgcacctatatatggagaaagcagttctaaggagattgtatgagcgctaatttaactgattttgtcacgaaaacaatagaggaaatgaactcgtttgatcgtgaaaatatggaatgtatgaaaaaactaattagaaaagcaattgatttttatcatctaaagtcttatgaagaagttgaggaaacccattcaggaaatgttcgatttttgcatgtccactctatgatggaagaaaatatgttatccaaaatgatagtggtcacaagaaacagtaaaactgatttggatattgaaggtgtatatgaaggatatgttgtaagagaatattaatgagacgaaatcacaaatagaatatgccaatttttttgctcaggagatgtattagatatgaaaaagtcgaaaggttctattgaatcagagatcagtaagtccattactcaatgggagaaggattatcttggacgggggtctgtatctgttaagactgatatactgcgggacatgatcatcgtcaatttaaaagggattttaacaccagccgaatatgtagtttgtggatcaaaagagggtatgttatctatcaaacaaactcgttcggagttagtcgaatcaggtatagaaggccttaaggatattatcttaaaaataaccggagaaaaagtgaaaagttttcatactgatttaagctcccggacaggtgaacgagtgatggtgtttaaattatgtaatgatctagagaaaaatttggaaaagatcttataatctaaagaaaataaaatgttttgacggtatggaatctgttgtgaattgaacataatgaactgccgcttcttttgttttacaattatggcatcattgataacttttattcatatcctaagcggacataaagagatgtcaattcatagtacactgacttgttattcctgtcgaaagatctaacatccgctgttgttatgagcggatgtttttttatctattttaaatacatgaatttgatgctggtgattagtcacttgaacaatattaaattcactttaattgaaaacatccttgtcacctgccgggttcccacaagtgtttagtgacatgattatgagaccaatttcgtaaagcatgatgataaatttaagaggtgaacaaaattgatatgctgtcttcagtttcatttcacggaattagtcagagataaacctttaattaaatatatccaaaaaacggattgacatatcggaatataacgatataataatcgatatggaaccaattgaagtattcaaagccttatcaaatgaatcaaggctgcaaattttacaatggctgaaggagcccgatcgtcattttgcaccccatgaagggattgatatgaacacaatcggggtatgtgtcagtcaaataacagacaaattgaaaatgacgcaatcgacagcttctcaatatcttaccatccttttaagagccggcttgattaaggcggagcgtattggaaagtacacatattacaaaagagatgaagaagccattgggaaacttgctgactttcttaaaacagagatataaaaataaacatcaaaagatgtttatttttacaccatacatatcgacatattacgatgtgtttattttttataataacatatcgataattcgtgatatgtttattaataattaaggagtgaatgttttatgtctaacacttggaaaatttatattttagccattgtcagctttttagttggaacctcagagtacatcatttccggaattttggatcaaattgctcatactctcgggatcactttagctgccgcgggccagcttattaccattttctcacttgtatatgctctttctacacccgtacttatggcgttgacagcaagtatggatagacgcaaattgatgatgtatgccctatgtttgtttgtgttcggtaatgtcctggcttttgtactgcctggttatggatggtttattgcagcgcggatcattatggcgatgggagcaggtgtggtggttgtcaccgccttaacgattgccgctaaaattgcatcggaagggaagcagggaagtgccatcgctacggtcgtgatgggatttaccgcttctttaatcattggtgttccgcttggaagaatgatagcagtagcattaggctggaagtctgtatttggagcaattgctttgttgggattgatcgcaatggtcgttattttctttactcttccgcatactgaaggggataagcctgtgcctttgcttcaacagcttgctcttttcaaaaaacggaaagtggctatgggattatcaatcactttcttctggctcgggggatattctgttgcttacacttatttgtcaccgtatctcttgaacatctcaggtataaatggcaagctgctcagtggtgttttgcttatatttggaattgccagtttggttggatcaaagtttgggggatatagcaccgataaatggggagtaccctttacactcgttggcgggatgacgttgcatatcgtcacactgattcttctgtcacttgttactcattcctatatcggagtgttggtgattctcatattatggtcgtttgccgcatggtctaccggtccgacacagcaatttcacctggctacaatagaaccggaaatgtcaggtgttttgcttagcatgaatcagtcaatgatgcaattcgccatggcggtcggcgcaggaataggaggggtttttgtggaaaacgtatcattggcctcgattacctgggttggtgcgttaggggttatgattgccattattgcatcattgctgattttcaattcgcaaccgaaacaagcgctaaaagatatcaatcaataatttcgaaagatctaacatccgctcgttatacaagcgggtgtttttttatacgctcaactagaaagcacactgtagctgaaagggatttttgccgacggagagctgaagcacagcaagttataatatactaggaagggaaataacggtatggcggaagggttctaacgcttctcgcctgtaagatcattactttgaggatgtgtcatcgtgaatcaaaagacgtacattgaaatgagcaggacatcgcagtacatcaacaaaatgagagagtattcagtgctaattgatggggctgagatgggaaatatcaaagatggagggaggctgcgaattgatttaccgcctggtgagcatgttattcaagtgaagattgcttggtgtacaagcccaactttgaggtttactttagcggaaggagaagtgttgaagtttagatgcggaagtccacttcgaggatggaagttgcttttggcgcttttttctgttttgggccgtcctgaaaattatctgtttatcgagcaggaagaagagaaaaagctttgtggtgactttgatgtgtgaataaataggaataaatagattaaatacccctgaattatgttttgtgaaagattgatataagcggtagccttctcaatgtcgttctccttggagaaggctgcgtataagaaattctcggactttgcggatagaccttccgatatccatttcaggattaatgtcttctgggtggagagtccgatttcatcatagtatcgcagtgtttttgttgatactttgcatatctttgaaaattcgccgatcgatagccgagtgatcacctccaagctccaaatgtacacctttccgtaagggcaaagttaaatgtgaaaataaaactgttccaaagttaatcagaaatttattttcatattgtatcctttcagtatcaagtgaaaggagcatcatatgaaaacattatggaaagtcctcaaaattgtttttgtcagcttggctgctttggttttgcttgtatccgtctcggtatttatttatcaccatttccagctaaataaggaggcggcactgctgaaaggtaaaggcgcagtagtcgatgttgacggtaaaaagatgaatgtgtatcaagagggaagcgggaaggatacgtttgtgtttatgtccggttcggggattgctgcgcctgcttatgaaatgaaggggctgtacagcaagttttcaaaagaaaataagattgctgttgtagatcgggcaggttatggatacagtgaagtgtctcacgatgacagagatattgatacagtattggaacagacgaggaaagcgcttatgaaaagtggaaataagcctccttatattttaatgcctcattcgatatccgggattgaagcgatgtattgggcacagaaatatcctaaggaaatcaaggccattattgcgatggatattggattgccccagcagtacgtcacgtataaattgagcggagttgacagattgaaagtgagagggttccacctgttaacctcgattggttttcatcggtttataccttccgctgtatataatcctgaggtgattcggcagtcgtttttaactgatgaagaaaaagaaatctataaagccattaactttaagcaattttttaatgcagatatggagcatgagcttttacagtcttaccaaaacggcagcaaatctgtgaatctgccggcgccaaaggaaactcccgtcttgattttagatgcggtctctgaccaaaatagacattcaaagtatgctatacaaaacagaaaagactataaagcgtttgcggctcaattcaatactgccgatataaaggaactgaggggaacacacagtatttatttatatcagcctgatcaaatatataaactgtccatggagtttatgagaaaggttcgctaggatgaagggttatcatattttaatcgttgaagacgatgtgatgattggtgatttgctgcaaaagattttgcagcgtgagggatatcgtgtgatatggaaaacagatggagcggatgtgctttcggtgattcagaaggtggatttggtcattatggatgtgatgctgccgggtgaagacgggtatcaaatgtctgcaaaaatcaaagagctggggctgggcattccggttatttttctttcggcccgtaatgacatggacagcaaacttcaaggtttgcagatcggcgaggattatatggtaaagccctttgatccgagagagctgctattaagaatgcggaatatgcttgagcatcattatggcacctttacgcaaatcaaacatttgtatattgatgcagtaacgaaaaaagtgttcaatgaaagcctgcatgatgaggtattatttactgcgattgagcggaaaattttcttttatttatatgaaaaaagagacagtatcctgacaaaggaacatttctttgaatatctatggcagctcgaagatagaaacccgaatattgtcaatgtgcatattaaaaaaatcagagctaaaatcaatgatcaagcgggtgagatgattgaaaatatatatggagaagggtatcggctgaataccgttgtgaagaaatgaagctcaagacaaaatatcagttgttattgtttacggccgtcattagtgttccgatgctattgctggcggtcagtgttttgatgtctgtgatttatgacagcatgtttaaaacgatgaatcatggtatgccctttcacaggtcgtttgcgtacccggcaatgatcgttgtatttttgatatcgctcttattgttagcttttttattttcaaagtcgattcattctctgttgcataaaatcaatctattaaatcaaaccattcggcatttggcgagtgatcaaagggtgcccgataaaattgaagtgaagcgtgcggatgaaatcggggaactgatcaagtcggtcaatttgttaattgaacggacgacatatcgtgaactggagctgagacagcaagaggaaatcaaaaaggagcttttgcaaaaactgcggcatgacattaatacacctttaacggctctcaggctgcagttattttatttggaagaccaatgtcatggtcaggctgtattcgaatcattgtatcagcaaatcgaatatatctcggaattaaccaatgaattcaatctatattccgctgagacgctggaaagctcttatattgtaaatgaagaagtgcgtctaaacgagctattagaaacagcggtgaaaaagtgggattatttatacagtatgagtgggattgagctgcactataagccggcagatcaagatgtgatatggatgagcaacgcgttatggatgcaaaggctgtttgataatatttttcaaaatacgttaaagcattcaaaagctgaaaagatggaagtcacgattgaacatggcgatgtttttattcgtgatgacggtattggatttgatcggaatgagagcagtgagggacttgggttaaagattattgaggatacatgcaggctgcttgcgattacttatgagctgcatacaaatgataacggaacggggttcttgttttcaaaagagtgaccccgctgatgtttttctttctcctataaaatttatataataggagaaagaaatggggtgaacagcatatgtttaaaaaaatcatcaaaacgattaagtacctctcaagcagttctagtgaccgatatcgcagacaccggcattacagcagcagtcggcgcagacattatcgcagctacagcagcagttcgggcaaaagaagacactacgaccgttatggcggcagtcatcgttacaaacgccggagctacagcagcagttaatccaaaaaaagttcttgttccgcttttgggacaagggtttttttatgtgaccgactgaatggcccggtttagatcctcgcgaatggaagcggtgtgctgatactcttcctcaatgcccaataatcttttcagcagcaaggttacttcctttgtcagtgttaattcctccagccaagtgccatttttcttcttttttcctttatattgagagtacagcaggaataacagcgtttctccgagatcgaagaagtcatcctgttttcgtacctttatttcctccatttcttcaagagtcaattgtttggcaaggccgaaatcgatgaggcagagcctgccgtcattgatgatgatattaggcgttctgatgtcgctgtggaaaataaggcgatcatgcaggtattctataatctcaagcagctgcgaaatcagttgtaacgccataagctctgtgaacggctgttttcgaaaaaataataattcttctatattctctccctcaatgaactgcatgacataataagcctgtccgtctatgatgaactcatctatgaagcccggaatttgcgggtggtgaatgcttttgagcagttttatttcctgctggaaccggactttttctttttcctttttcgcttttgtcggccgaagctgttttaagacataaggtgtttgagttaggatatcggtgcacaaataaaccaaaccgtagcctcccataccgaggcactcttcgattttgtattgatgatttaagataacgccgttctttagagggcggtcaaatagcagtttttttagaagttttaatgccatgtctgcacttcccttggttgtactgactatagtttaccttctagactgagaataaaaaagagccggataaccggctcggtataagttaaaactgctttgtcacgtcgtattcataatctatttttgcttttacgttgctcatcgtcgatctggctgtcgctaatgtattatatttaaaactccatacctttgccacactgagttgatctgacaaagagatatcataagaccctgaagtcgagctgtttacaagagcacggcgccattcgttgttttcgctcgtcatgatcaggtggcgtgtatttccctggcttggtgtttgagtggcggttgtctgaactctggttacaatggcatcacgcggtatcccagattggtttgttaaatcaaccttgatcacgctggagtcagaacctgaggggctaaggcttgtatttcctttattttcagcaacgccgctgaattggaatgttccgctgcccgatttgattcggtcttcaattgaaagtgtaaaatacatgtttccggtataggtgcctcgtgacactttcacataaaaggtatctgtcgtgttttgggcgtctgcatttgcataaataaaagaagaaaacgtattagggttaataacttctgtcccttgagaaacaggtattctgttcttgtcataaatttcaattttcatccctgtatacgcgctctggtatgtactcctcacgtatactttttctcccttattagccgtaaaagtgaaataggcttcatcttgaccagcttccagtattgttgtatcgatatttttatatttccaataaccgatcggcattgcggtatcaaatgaattgtttcctgtgatagcagtgactctgacagctgatgccgaatacgtaaaggtggataagacagacagcataacagcgaatggaataagccattttttcaccatgcaaacaacctccttttatttccatcatacataataacgatttaggtgtaaataaatgttttttaaggttaatatatacattatctttgccgataaaaaagaataagagagaatactcgggagggaattcaatgcgtctgaatcggcaatttatccgcactcagctgatggcacagaacatattgagcaagaatgcgcctgccaaacgggagaatgcgactgaaaatccagcggcagttctggaaaaggcatacagcaggcttaagtcacaatcttcaactgggggaatcaatcagttcaattattctaaaaccagcgtgtcgggaaacagcggggcgttcagcaaagtgtatcaatcagcgaatgatcgaacagtgacagacacaggggaagaaacagtgattcaatcccaaaacccctatgaatctgagagtgatatcagaatcaaaatactagatgaaaaatacagcaggatgaatgcgattaataaaacaaagtctgatccattaggctatattaaggataagtaccaaaattcaaagtctccttatttcagaagtgatctgtcagctgcagaaagacaggccgcttacgataatgaaacagaatggctattcaaagggaaggcgcaaaactataacctccaggatgctgcgtttcggaatgtcacatttcatggggaagtggaagctgagaatgaaaaggtgtatcagcggggacaggttaaccagcagctgcaagtgctgttgaatcgaaaccatattcatattccagaggggacagagctgacgtttacaatcacaccgattgactatcaggtgcgggtgagcgggacagacgatcaggatctgatcaagcaaattgagcaagtgctgcaatctggagacaacagcaaagaactatttttacacatcatgaaaagtcaaagcagtgattcaacacaattttccgaagaggcctataaaaagtatcaggcagctcgtgagatgtacgaagtcacaggttatcaattgaaggatttagaagtcattgatggacggtacgtcacgcctgatggacgtgacttaatagatgtatataaggaagagcttgaaaaagatccagtgcagaagcaaacggcttcttatgctatatcttactatcgttcagagctcagtaaaatcgcggaagccgggtataatgccattccggatttcatcctatcaattgattacagcaatggatctctgagagatgtgggacaaagcaagagctatgggaccggagataccgggtggcttgaagcattaaagcgtcaaacgggtgtgaattattaagtaagctgttcatgtagaacagcttattttttatgagaatctaaggggtgtattaattttaatattcaaacaattttattatttttatataaaagattttaaaagaagtgaacgattcaaaactctgaacaaaggtgtttacctgaaaaaaacaattgtattttccggagaaatttattatgatgaaataagtaatttaggagattatataacaattttaagtttgaattttctgattgttatcactgattcatgtgaaggcaagcaggtctgctgttttctcatttatgagtattttgttaggaggaggaagaggagtggcaaataaagaattaaagaggggcctgggcgcgcgccatattcagatgatcgccttgggcggtacaatcggtgttggcttgtttatgggttctgccagcacgatttcatggactggtccatctgtccttctggcttatgcaatatgcggaatttttatcttttttattatgcgtgcgatgggtgaaatgctgtatgtcgagccgagcacaggttcttttgcgacgttcggccatcaatatattcatccgatggcaggttatataacagcatggagcaactggttccagtggattatcgtcggcatgtcagaaattatcgctgtcggttcttatatgaagtattggttcccggatttgcctgcttggatacctggtatcgtggcaatggtgattcttggtgcggcgaatttaatttctgttaagtcgtttggggaatttgagttttggtttgcgatgattaaaatcgtgacgattatcttgatgattattgcgggaatcggaattattttcttcggttttggcaacggcggagatgcgatcggtttgtcgaacctgtggtctcacgggggcttctttgcaggaggtttctcaggtttcttctttgcactgtctcttgtcattgcggcctatcaaggagttgagctgatcgggattacagcgggtgaagcgaaggacccgcaaaacacgctaagaaatgcgattcaaagtattatctggcgtattttgattttctacattggtgctatttttgtgatcgtgacggtgtatccttgggatgagctcaactcactcggaagtccgtttgtgtctacgttctcgaaaatcggaattacggcagcggccggcattattaactttgtcgtgattactgctgcaatgtccggctgtaacagcggtattttcagcgcgggccgcatgctgtatacactgggtgtcaatggacaagcaccgaaattctttaagaagatttcacgcaatggtgtgccgctgtatggcacaattgcggtgctgatcggtttggctgtcggcgttgtgctgaactatatcgcgccgccgaagatctttgtctatgtatacagcgcaagcgtgctcccagggatgattccttggtttatcattttgatcagccatatcggattcagaaaagcgaagggcgctgcattagataaacatccattcaaaatgccgtttgctccttttacaaactatttgacgattgctttcttgctgatggttctggttggcatgtggtttaacgatgatactcgtatctccctgattgtaggcgtgattttcttagcgcttgtggtcattagttattatgtgtttgggattggcaaacgcacgcaggccaatttaacaaaaagcgaacaagcagctgaataacgataaaaaagagacattcgcggatgtctctttttttatttttcgcgtatggattttccctattttagcaagctatagggtaaagatagcagaaggaaaggtgttcataaaatggatgttacactcggttatttgcgcgaatcactttcgaatcatctagaaaatgaagtctgccagcgtatttgcaagaagatgctggcgaagcgttatgcaaatgaaggggaatttgtaaaagacttagatgataatgaaatgtcttttttgaaccatgtattagaaaaagaaattaagtatgcccagaatgaacaggatcaaaaacgggccaaggaattaaacgaggtgtatgaattactgctttgagaaaggcgggtaagaaatgggagcaattgaacgaagcggatatacatttcagccggagtttagcgttgtccgtcaaaacggagccatccatgtgtaccatcaaggagaatttgtggaagaaatcgaatttgaatttaacggggaatatcccgatcatgatttgattgaagagcttgtgaatcattattgttttgagcatgagatttagagccctgccgtgcagggctcttttatttaggatgtgatcaggccatactttttcaggatatccacggtgatgtttttggcttttgtgccggaatcatcgacattggtgacaaagacataagagccatgctctgttttgatgaatccgacaaaccatcctaatcccatatctgtcaggcgagttccggttttcccgtagagcgtgtaatgatcgccttcctcttgaatcatcatgcgcttgacggttttcattaccggcttgtcaaatggaagctcctcgttagccagtttctccaaaaaagtttcttgttccagcggagatattgtgagcgagctttgcagccaaaactggtcgattccccgctgatatcctcgttgccgtaagatagagtatgaagccatgttttcattctttcctcgccgatatctctcgctaatgcctgataataccagattgcggattcgcgcatggccgagccaagcgtatggtcgcggttccatgtttcgaattcacgcttgaccccgtcccatcgtttaacatcgtattcatctcttacagctttgacctgcaaaccgattaaagcgttcacgactttaaaggtggattgcggagtttgtctttgatttgcccgttttctgttatagacaaatgtctgatccttttgtaaatcgtgaagaatgaaggttccatccgtatccttgaattcgtcatcgacattcattctgctgacattcaagtgtttttcatgagcagatgatgctgcgtggacggagaagccgccgatccctacaatactcagcacaagcacaacatatatccattttttcattttgttctccccttcgttttgattaactaccttttctctctttcgtttgttcttcctttgaaaaataatcaaaaagtgcttaaatttggttttgtaaacaaatactgttactgggtttatattcggaagataacgtgaaaatagagggtaaaaaggaaggcagggtaagcggatgaatgagcagattccacatgacaaaagtctcgataacagcctgacactgctgaaggaagggtatttatttattaaaaacagaacagagcgctacaattcagatctgtttcaggcccgtttgttgggaaaaaactttatttgcatgactggcgctgaggcggcgaaggtgttttatgatacggatcgattccagcggcagaacgctttgcctaagcgggtgcagaaatcgctgtttggtgttaatgcgattcagggaatggatggcagcgcgcatatccatcggaagatgctttttctatcattaatgacaccgccgcatcaaaaacgtttggctgagttgatgacagaggagtggagagcagcagtcacaagatgggagaaggcagatgaggttgtgttatttgaagaagcaaaagaaatcctatgccgggtagcgtgctattgggcaggtgttccgttgaaggaaacggaagtcaaagagagagcggatgacttcattgatatggtcgatgcgttcggtgctgtgggaccgcggcattggaagggaagaagagcaaggccgcgtgcggaagagtggattgaagtcatgattgaagatgctcgtgccggcttgctgaaaacgactcccggaacagcgctgcatgaaatggcttttcacacacaagaagatggaagccagctggattcccgcatggcagccattgagctgattaatgtattgcggcctattgtcgccatttcttactttctggtgttttcagctttggcgcttcatgagcatccgaagtataaggaatggctgcggtctggaaacagccaggaaagagaaatgtttgtgcaggaggtccgcagatattatccgttcggcccatttttaggggcgcttgtcaaaaaagattttgtatggaataactgtgagtttaagaagggcacatcggtgctgcttgatgtatatggaacgaaccacgaccctcgtctatgggatcatcccgatgaattccggcctgaacgatttgcggagcgggaagaaaatccgtttgatatgattcctcaaggcggggggcacgccgagaaaggccaccgctgtccaggggaaggcattacaattgaagtcatgaaagcgagcctggatttcctcgtccatcagattgaatacgatgttccggaacaatcactgcattacagtctcgccagaatgccgtcattgcctgaaagcggctttgtaatgagcggaattagacgaaaaagttaaattaaaaagctctcttcctttatcgaagagagctttttgattacttctttttttcatcgtagtattggacgggatacatggagccttctgataccattttgttgtcctcgatatcttgcgggtccgggtggccggctttatcaactgggaacgtttccatgtctggctgttttgttattttcatcttcatgctgtgaatgaattctcttgccttttggcgatttgacgggtcctttaatagataagaagtgatgccgacagttgaaacagcgagacctgaaagtaacagcttttgtttcatggtgatactcctttctattttaagaatagtgtttcctgtatcattcccgttttggaaatagctaaacctattgtgtttttatcattggaattcacagtaaattccatttaagaagaaattagtgacttcattcctgtattggaaggtaatatacattgacttattatagtttcagtcaaaattcgataaatattgacaaagtaaagtaatcagaataataatataattagcaagagaatgtcatcatacatgaaaggtgtttacgatatgaatcaattgcatcgaagaatgggaacgttttccctcatgatggtcgggctcgggtcgatgatcggttcaggctggctgttcggggcttggcgtgcggctcaaatagcaggaccagctgctattatttcatgggttattggaatggtcgtcattttatttattgctctttcttatagtgaactaggttctatgttccctgaagcgggggaatggtaaaatatacgcaatattcacacggttcgtttatcggttttattgcgggctgggccaactggattgcgattgtgtccgtcattccggttgaagcggtggcctccgttcaatatatgagttcttggccttgggaatgggcgaaatggacaagcggtttggtgaagaatggaacgctgactggggaaggactagcatttgcctctgtattgcttctcatttattttctgctgaactactggacagtcaatctattttcgaaagcgaattcattaattacgatttttaaaattattattccgggtcttacgattggagctttgctgtttgtcggattccacggagaaaactttactggcggtcaaagcattgcgccgaatggctgggcaagtgtgctgacggcggttgccacttccggtatcgtttttgcgtttaacggtttccaaagcccgattaatatggcgggtgaagcaaaaaatccggggaaatcaattccgattgcggttgttggctctcttttcgttgcaacagtgatttatgtcctgctgcagatcgccttcatcggagcagtgaatccttctgatattgctcacggctggagccatctgaattttaattctccttttgctgatctggcgattgcgctgaatattaactggcttgttattgtgttatatgcggatgcatttgtatcaccgtctggaacggggattacgtatacagcgacaacgtcccgaatgatttacggaatggaaaaaaacaaatatatgccaagtgtattcgggaagcttcatccgatttacggcgttccgcgacaagcaatgttctttaacttgattgtgtcgttcatctttttgttcctgttcagagggtggggtgtattagcggaaattatttccgttgctacgttaatttcttatatcaccggcccgatcacagtgatgacattgagacggacgggaaagacctgtacaggcctcttcgtttaaaaggcttaaacgtgattgcgccgcttggatttatcttcgcgtcactggtgctgtattgggcgcgctggccgttaacagggcaggtcctgtttattatcctgatcggtcttccgatttatttctattatcaggcgaaggcgaaatggaaagggtttggccggaactttaaagccggcgtctggatggtgttttatctgctggccatgatggtcatttcttatttgggcagtgataaattcggcggcctgaatgtcattcattatggctgggatatggttctgattgcgatggtatcacttgtattctatgtgtgggcgctgaagagcggctaccagacagaatacttaaaggatgcgaaagagataaattctcagctgcttaatggacagtcagaagctgctgccggaaaagaataaaatatagaagaaaaccttgcgatagttgtcgcaaggttttttgcttttaataaccctttttactttgtggaaaagatcaggatagttggtgaacactcctgttacgccccaatcaagcaggcgatgcatatcagcttcattattgactgtgtaagggtgaagcaggaggccgtggctgcggatcatacggacgttttcttgatttaaagctttataatccgggcccgcaccgacagcgtatgttttgatttcttccagggcagcatctgtcattgacgccatttgtttggcttccagcaattgaacggtcggcagttttggctgtaattgatggacttttaccagactttctttgctgaacgattgaatgatcacctggcctggcttagaatgcttccccagtaatttatgtttctgcaaagaagcgatcagtttttcttccatacctgggtaggtgtcaggcgattttgtttcaatgtagtagttcgcgtgctttccgaaacggtctaatacctcttctaatgtaggaactttaaggccgacgtactgcggctttgctttttccggataggcttcattaaaccaagaaccggcgtcaagcttcttaatgtctgcgagcgtatggtctttcacccagcccgttccgtttgtggtacggtccagtttttcatcgtgcatgacaatcaatttcccgtcttttgtcatttgcagatctaattcaatataatctgctttcattttctgagcggtttcgtaagacagaatcgtgtgctcaggcacatatccagaagcccctctgtgcgcgacggtcaggatacggtcaggtgacagcaggtttccttttgacgctgccgacactggcgttaccataaatgagagtaagcccagcgacagaacaaacaaggccagtattctattttttctcatgatttctcctccttatagataagcactacctgtctttcatattaaaaaacggatgtaaacggcgtgttggaaaactattaatcttttatgtgtctttcttaaacatgctctgcccgttttcctgtattccacgtcaaagccaagaagacgatggcaagaatgcaggaagagatcagcatgataaagccgccgttccaattaaagcggtcaacgacaaagcccataatggcgtttgcgaaagcggatccgccgatgtatccgaaaaatccggtcaaaccggctgcagttccggctgcttttttcggtgctagatcaatcgcttgcaggccgatcagcataacaggtccgtagattaagaagccaatgctgatcagggcgatattgtctacgagcggattgccggccggattcagccagtacaccaatacggcaatgaaaacacccgccataaacaaaacgcctgccggtgcccggcggcttttgaagaatcggtcactgatccagccgcacaagatcgttcccggtatgcctgcgtattcgtaaagaaaatacgaccagcgcgagtcttcaggagaaaagcctttggcttctgttaagtaagtaggcgcccagtcaaccacgccgtatcgcacgaaataaacaaatacattggcaaaagcgatgtaccaaagaaatttgttgttcagcacatattgaaaaagaatttcttttgttgttaattctttttcctgatttttaaaagcgtgttttggatagtcattccgatactcttcaattggcgggagtccgcaggattgaggtgtatcacgaaccaataaaacaattaaaaatgaaatgataatggcgatgatggcagggaagaaaaacacgcttttccaagtgacgaacatcgcgatcccaagagtgacaagcggagcaagaataccgccgcctatgttatgggcgacattccagatcgacatttttgtgccgcgttcacttatggagaaccaatgggccatcgtcctgccgcatggcggccagcccattccttgaaaccatccgttgataaacataaaaataaacatgatggtgacgctcgaagtcacccaaggcattgaaacgaatagaatattaacgattgctgataaaaataggcctgtcgccagaaaatatctcggattacagcggtcagacaccattcccatgatgaatttgctgaagccgtacgcaatggacacagcggccagcaccaaacccagttctgttttcgaaaatccctgttcctgcagataaggaatggcaaaggcaaagtttttccgcagcaggtaatagcctgcgtagccaatgaaaataccaatgaatacttgcagcctgagccgtttgtatgccgcatccatctttgaatcatccagtctctcaatgtgaggagccggtttaaatatattaagcattaacaattatccccctttgctgtttgtgctggatgtgtggcgtgcctcctttcccgaaaaacaaaaagagccagaaaacaccccttgtcaaaaggggttggattcctggctctcctcatctccatccaagctattaacttatcatgatagcgctttcttaaattatcatagtccggagcgaatgtaaacgggtaattttcaaattgggccttagggaagtaaatattatccttttactaaatgcagttatgtttttttactagtaacataaaaatctggagggaggctgtttaaaggtggatgaattagatatcgcattctttattttgccgttaggaattatgctgctatcgattgtcgggacctgtatttgtaaaaacccgtatctgatgccaatgcttagtttggtgatttctcttgtgctcacctttaccatttttaatgaatcatttttgggatgggctgttgtctatagcttggtttctctggctttatcctatatcacattgattgtggtaaggaaaaggaaggaatcaggaaattaaaaagacctcactttctaacatatcgttgactaaggcaactatatgtgattataattggcttagtcaacaatattagaaagtggggattgatttgaaaacaagagaatcatctgtcggattaaaattcagaaagttcaatcgattttatacaaacgtccttggtttccttaatgagcacatttacgacagcccgttttccttaacagaaacacggattttatttgagatttataatacgcctaattgtacggcaaaagctcttcaggataagctggggcttgaccgggatatgtcagcaggattgtgaagcagtttgaaaaagaagatttgatctataaacagaggagcaaagatgacgcccgccaacattatatttttgtcacagaaacaggaaaaacgatttataaaaagctggaggagaaagccaacgaacaagtagaactgatgctgaaggaaatcaaccaaaaggagcagcacaagcttgccgaggcgatggcagagattgaagcgatcctttcacagtcgctttctgccagagcatcagagatatcgattagagattattttctttcggaggatcttcaactccttattgagaaacaaagacaattttacgcggaggctcacggttgggatgacacgtttttagcttatcttcaggagacatttgacgctgacatcgaaaaaatatggattgcggaaagcggcgggaaatttgccggctctgtcgggttggtcaagcatgatgaaaagacagtccagctcagatggtttctggttgatgcggattttcggggcagggggctcggcacgcaattgctggagcatctggttgcatactgccaagacatgaagtttgaccgcattttcctttggacggtgagtaccatggctgaggctcgtccgctctatgaaaaatttggattcaagataagtgaagtgaaacaagaagcgccattatggggacagcagctgacagaagaacggtgggatttggagctgtcatgaaaagactgcattatgcttgggtcatcgtctccgtcaccttcttgatcttattggcggttcagggggtgcggctgtcgtttggtgcgtttgtggagccgtgggaacggcagttttcaatggatagaagcaccatctcgctgatttcgacgatgagttttattgtttatggcatatcacagcctgtgatcggtcggcttgtggacaaatggggtgcccgggctgttttggcatggagtgcgttactgacaggagtcagcattttcttaacataccttgtgacttcgccttgggagctgtttttgctttacgggctgggtgtctcgcttggagttggcggagcatcgaatgtggcggcaagtgtattggtcgtcaattggttcagcaaaaagcggggactagcctttgggatcatggaagcaggctttggcgcggggcaaatgcttctcgttcccggctcactcatgttgatccattggtttagctggaagctgacggttgtggtgttgggactgctgttaatcttgattgtctttccggctgcgctgctgatgctgcggaacaatccttcagaaaagaatacagagccgataggcggactggctgcatcagaaaaagaaacagcacccaaaacaacagctctttcagtggccgggatgtttcgtatgaggcaattctggttcttgatttttccgtttttgatctgtggttttacgaccgtggggctgatggatacccatttgattccgttttctcatgatcatggcttttcaacgacagtcacgagtgctgctgtcagtcttctggcaggctttaatattgctggcatcttgctgtccggaattgtagcggaccggtggagcagccggaaaatcctgtgctttttatatgcggtgcgggcgctgtcgatcgtaattcttatttacagccacgagccctacttgcttttagcctttgcgattctgtttggattagtggactttgcaacggtagcaccgactcaaatactcgccacccagtactttcaaaactactcgatcggcctcatgattggctggctgtcactcgcccatcagatcggatcggcactaggtgcgtatgtgcccggcgtcatctacacggtaacgggtgagtatacactggctttttatttgtcgattggaatgctcgtgcttgcgagcgtaatgaatgtgatgctgagggagccagcggcggttacgcgtgacagtgcggctgtggtagacaagtgatgagagcagaggataagcatctctgatttgggattattcagagatgctttttttgtatttttgttctaatacgaagtcgatcataccgactatgcgggcgttttcggatttttgtttgaagttttgggagacttgaatggcttttgcgtttttaaaacaagaggcaagccagataaacccgacaacaacaaaaaataatctagcaagtaaactccctgcatggggtaattcattagttgtaaaatataaaaatagagtaactaatgtaccgtagattactgtttttatactatgtataagagttagctgaggctcactaaagaatacttttagttgattcagcatgatagaatcctgcttggttagaaaagtcaggatttctttatcattttccttgtactgtttaatagtttcggccatttttactgtctctttaaatgtttgttgatttagagtcatccagtatcctccttaaaagtaaagcactacatgaggaatgatatagatccatagacccatgtagtgctgatatattatttatttgcagaagggaataaagctaaaaacgcacttataaaagctacagctccacctactgctaaggtttcaggtatagctgttagcaaggcagcaattcctaatacagcagccactccaaatgtaatatgagtgagagtagattcccaatctggtgagtatacttcctcagtatctggtaaagtaaagtgcttctgttttattttaaacgtaatcgtagtcgttagtccagttgtgacattgtcacctactggaatatcaggtgtatagattttaatttgaatgtttaaagattcagctgttggatttacataaacctccaaataaccgttgcgtactgataagctcagactatttaaaaggttttgataagagtcgatttgtgacgcagtgagagacgtttgagtgtcgcccaataaacccgtgatataggcacctggtttaccatttgtaatggtaattgtgtttggtgaaccttcacttggtatggttgccagaagtgaagttgatagaataatatccaactcaggtgatgtgaaaatggtttctgtcgtatcaaattcaaacatcgcgtttgccagacttgttagattttctaaagctggaatggtagataaaatgtctgtcagtgtacgcagtcttgcatcatataccggatcagacggcggatttacattgcttgcacctgagtctcttcctgaatacccgtctttatcaatcccgatgcttccagagccgcttccgatggttccttcataaaattgatcaaaggcccaattgtttggcatcggatagccgagattgccgctaaatcctgttgacatatttgccacaaaactatactttgtcattcctgcttctgatgtacggatacaaatgtttcttggtccgtaaacccctatttcatacttaggtgcggttgaaaatgtctgcatttttgtaaatgctgacttaatctcttggaaataaggaatgattttatcggtcacttcataatcgtatgcatcaaaatcgacagcgaaataaatggtcgtgcctgacggaaaacctaatcttctagcagcagaagcggcactatatgcatctcttgtgccttggtctttgacaaaataagaagattcatagccgccgtcttgataaattgggaaaaccttcaatccggcatcaagaataactgcaagctctttagatgtcagggcttttgatgtgaggccgctgcttgtccgcacatttccggtcaaatatctgccaaccgttttataaccgttattccgcagtgtttgagctttttctgcggttataattgtagcagtgtcacaagcagaagcggcgcgagttgtgtctcctgagcttgataataaagctttaatggttggcatatctgcataacctgtttgcggcaggcacatgaactcttgaaatgctttaacagctgaaacaacacccacaccatatttgccgtcaaactcaccaggatcgaacgattttccgttacaatagagggcgtactgaacaattaagacaaatcctgttcttgaatcgccgggagttaaagtagggcataaacttgtggtgccgtttccgaaaaatccattggcaacacttgtgctcatgccttcttctttttgcagggcataaataagagctttatttgtatcgcggccatacagtccgtcacaaggcattaacccgatatagtcattgtagtcccgatttaagttttgttgaatctggcgaattcttgaatcaccccagacaccagcttaaaagcgctcatgtctaataaggctttcataattaacgtggtgacaatcccatcctgtgttgtcagtccggcagctttttgaaattcttttaccgcattttctgttttttcgtaaaagacgcctgtaaaaccgccgggattaaagcctttacaccataaagccccttgtaaaataaaattcatgttgcttggttttgaatccggagcttggcgtttaagaggcttaaataaacgctgtgttgtcggcccgaagttatcggctggctctgagatacccaattcaatttgaagcgcccgagtcagaccgtagatcgtatcccacccagttttcccgctttcttctacagggttatacccatgtttgccgctgtacgtatcgttcagccattgctgtgtgattaagaccatttcatcaaccatttcgattcctcctttgttagattgcgttcatttataggtggcaaacgtaggacaaaataaaaaaaatggatgccgttaagcatccattttacttccattctccaacagcttcgctttcggtttcatctccgagatgtagaggcctaaaagcgtaagggcgcctcctagaagagcgatccatgtcatgttttcatgcaggatcaggacggaggcggcgattgtgataaccgggaccatgtatatataagcactggatttgacggctccgagcacgccgactgaataattccaagtggcgaagcacagggccgaagcgccaatccctaagaaaagcatgttgagtatatttgaagcagatgaaaatcggctaaggtcaaaatggaagtcgaacaaaaataaagcgggaaccataaacaataaaccatacaaaaatactctctgtgtcagctcgatgatgtggtgttcgtaagcgcttaattttttcatgaatatcgagtatccgccaaacacgagagcagccccggcagccatgatgtctccgagcggatttagacgcagtacgatattgccgttgaacgtaatcaataaaagcccgatcagtgccgagccaaatccaatgaaaaaagtcagccgcagtttttcgccttcaagcagaaaatgggccagcaccgcagtgatcatcggaataatggacacgatcatgccgacattggatgcgtatgtataggtgagagctatattttctaatagaaagtataaggttacgccaaataaaccagccccggcaaataacagctcctgccgccaattcctgaacggaatcattttgggacggacgaggataagagcgataaagcccatcaaaaaacgataaaataatatttccattggagagaagtcagccagcagaacttttgtcgaaataaaggtcgtcccccaaatcagaatggtcacaatggctgcgatatgccccgaagtttctctttgtatgttcatctgtgaagctccttttcaaaaatcttcatgtattgcttcggcgtcagccccacctgccgtttaaaaaacttcgtcatatggctctgatcgctgaatcctgtctgaaatgccgcatcaatcggccttaccccttgttcaaggagttttttcgcttgattaatccggattgtttccatgtagctattaggggtaatgcctttttgttttgtaaatgaacgcaataaatgatacttgctccagcctgttaattcactcaaatcattgagtgtgacattttcggcataatgctcttctaaaaattcacaaaccattttgacttcgtctgatggttctggaacgctgctaaggaacgtgacatctgaataatggcggatcagctcttctaatagatgaagaaacagctcctccttacgcaaagcttgtttttcctcggatatcaaaatatgcaattcctgcaggctggctgtcagctcatggcggaataacacatgctgggagaaataagggagatgcccggagccagtaatctctttcaccgccttctccatgatatccggcataacattgatacaccgataatcaagcgtccggccgtcaatctgttcacagctatgcgtgtcacgggggttaaagaggagaagatcacctggattgatgatatattcttgatcctgacaggccagataccgttgccctttttcaataaatccaatcacataataatcgtgaaagtggttcgggaacttttgcataattcccttgaaacggtaggcttctatatgaaggtgtgggtcaagctgcagtgtgcgggtttcattttgcatgggatgcctcctgtcggtgtggtggttttggattaagtgtagcatgatttagggggatttcttgtatgatgttgctgtttaggaatagagaaagcagaccgttattggtctgctttcgtttaagaatttaaaagatttcattcctcaataataattatcccttttttaataaaaatttatttttcaaatatttcagttataatggtttggaacagataggaggggcaaagatgtatcaatcaaagaaggttttattgttaggttcaggtgagttaggtaaagaggtagtgattgaagcccagcgtcttggggtacagacggtggcagttgacagttacgagcatgctccggcgatgcaggtcgcgcataacagttatgtcgttgatatgctggacccagagcagatcagaaccattattgagaaagaaaatccggatttgattgtgcctgaggtggaggcgatcgcgacggatgaattgctgaagcttgaagaggaaggatttcacgtcatcccgaatgcccgtgcggccaagctgacgatggatcgggaaggcatcagacggcttgcggcggaaacgcttggacttgcgacggctggctatgaatttgcgaatacatatgatgaatttatacaagcggcagcacagatcggttttccttgtgtcgttaaaccattgatgagttcttctggaaaaggccaaagtatctgccgctctgaagcggatttagagagctgctgggagacggcgatggaaggcggacgggtgaaaaacggccgcgtgatcgttgaggagtttatcccattcgaatcagaaatcacactcttaaccgtacgtgcggttaacggtacggcattttgcgagccgatcggtcatgtgcaaaaggacggggattatatcgaatcatggcagccgcatgatatgacagagcagcaaatagaagaagcgaagcatattgcgaaaacgatcacggatgagcttggcggatacggtctgtttggtgttgagctgttccttgcgaaagatagggtatatttcagtgaggtatctcctcgtccgcatgatacgggtcttgtcacgctggtgacgcaaaatttgtcagaattcgcactgcatgtccgggcgattctgggctttccgattacagaaatcacacagctttctcctggcgccagcaggcccctcaaagcgccggaagaattagcggattacactgttgaaggattggaaaacgcactggcagtcccaaagactcaagtgcgcgtctttggaaagccgataacgaaagccggacgtcgtatggcagttgcgctttctgctgctgatacagttgaaacggcaagagagaatgcaaagaaagcgttggaccagctaattttaaaatagagtttgaacaggccttgtcatggtacaaggcctgtttttttctttctccgtaaaagttttatcataagaatcagaaacccgattataatgtaaaagtcttccatcaatacgggtggttgacactaaaggagggagatgacaaaatgaaattagttccaagattcagaaaacaatggttcgcttacttaacggttttgtgtttggctttggcagcagcggtatcttttggcgtaccggcaaaagcggcagagaacccgcaaacttctgtttcgaatactggtaaagaagctgatgctacgaaaaatcaaacgtcaaaagcagaacaggtttccgccccttatgagggaaccggaaaaacaagtaaatcgttatacggcggccaaacggaactggaaaaaaacattcaaaccttacagccttcgagcattatcggaactgatgaacgcaccagaatctccagcactacatcttttccatatagagcaaccgttcaactgtcaatcaagtatcccaacacttcaagcacttatggatgtaccggatttttagtcaatccaaatacagtcgtcacggctggacattgtgtgtacagccaggatcatggatgggcttcgacgataaccgccgcgccgggccgcaatggttcgtcatatccgtacggcacttattcaggcacgatgttttactccgtcaaaggatggacggaaagcaaagacaccaactatgattacggagctattaaattaaacggttctcctggaaacacggttggctggtacggctaccggactacaaacagcagcagtcccgtgggtctttcctcgtcagtgacaggattcccgtgtgacaaaacctttggcacgatgtggtctgatacaaagccgattcgctccgctgaaacgtataagctgacctatacaaccgatacgtacggctgccaaagcggctcgcctgtttatcgaaactacagtgatacagggcagacagctattgccattcacacgaacggaggatcgtcatataacttgggaacaagggtgacgaacgatgtattcaacaatattcaatattgggcaaatcaataaatacagcaaactagccatattcatgtctattttgtttttatgcggatgcagttcgcagacgcattcttctcaaaaagaaacgactattcctgtcactcttcatgtggaggatgctaaggggctgccggtcgcaggggttcaagtgacgattgtcaaagcgccctcttcagatgaggagccgagtacagagattggcgagatacttggtaaaacagacaaaaacggagatatcaaatgggataccggcagaaaaggcgattactcagtcgcgttgacgaagggtgaaacatcagtaacccatcagatctcgttaacagaggataaaaaagatcatgccattccattagtcttcaaagaatagcagtttccttgattttaagggaactgccttttttatttattgcaggaaaccaaactatatactggaaatttattatgtgagataataagaaataggtattttttcttacgagacaaaaggggcgttatcctttattttatatcaatcaaacccggaggaaaaagaagaaaatgatacaagattcaatgcagtttgccgcggttgaaagtggtctgcgcttttaccaggcatatgatcaaagcctttctttgtggccgattgagtcggaagcattctatgtttctactcgttttggaaaaacacatatcattgcaagtgggccaaaggacgcaccttcgctcattttgcttcacgggggccttttcagctctgcgatgtggtatccgaatatcgcggcgttgagccgtcaatttcgtacatatgcggtcgatataataggagacaaaaataaaagtataccatcagcagccatggaaacgagagctgattttgcagaatggatgaaagatgtctttgattctcttggacttgagacggcacacctggccggcctttcgcttggcggctcccatatcgtgaatttcttactccgcgcgcccgaaagagtagagcggacggttgttatgagtcccgctgaagcgtttatttcatttcatccggatgtctataaatacgctgcagagcttacaggggaaaaaggagctgaatcatatatcaagtggatcacaggcaacagttatgatctgcatcctttactgcaaagacaaattgtggcgggcgtggaatggcaggatgagcaaaggagcctgaagccgacagaaaacggctttccgtacgtgttcacagaccaggaattgaaatcgatacaagtcccggtactgctgatgttcggtgagcacgaggtcatgtaccatcagcaaatggcctttgagcgggcttcggtattggtgccgggaattcaggctgaaatcgtaaagaacgccggacatctgttatctctggagcagccagagtacgtcaatcaacgcgtcttgtcctttttatgcgggggataaaatagtaaggaacatgaaaagattggcattcatttttcaaaaggtaacaaatgttgtataataatagaatttgaatgctgctttttttgggagcattctatgttatcatgcttattggagaaaaatttttcctgtaacgctattcgatcactatcgtcaaataatatagatggttttacaattggaggtttggttacactgtgaattacatcccctgtatgattacgataggaaacttcatttgcggattgctggcgattcattccttgctatatcacaacattcattcagcagtgctttttatttttacaggcatgttccttgatttctttgacgggatggctgctcgtaagctgaatgccgtttctgatatggggaaagaactggattcgtttgccgatctggttacgtttggggtggctccttctatgcttgcttacagtgtcgcgttgtataccctgccatttatcgggatcttatgcgcattgacgtacagcatttgcggaatgcttcgcctctctaaatttaacattgaacaaagcaagctcccgacatttatcggtatgccgattccgtttgcgggcatgtgtctcgttattctaagcttcacctataacccgatccttctggcaatcggcacttgcggactttcatatttaatggtgagtaaaataaaattccctcattttaaaaaacatgcggcagaaaacctggagtctgggagatggaattagttcagcaactcatagcggattacggttatctcgctatttttttgatgttggtattagggattgtaggattgccgattccagatgaagtaatgatgaccgttgttggctatttcacgcataccgatgtgttgaattatgagctttcgatattgatcagttttgtcggggctttgttaggtatgctgatcagctacatgattggcagaaaagccggacgcccgtttatcgataagtacggcaagtgggtcggcttaaaagaaaagagaatgatgaaagtggaaaaatggatgaagaaatacggtccatattctcttattttaggttattttattcccggcgtcagacatgtgacgtgctacttttcggggatcggcaaaatggatctgaaaacgtatgttgcgtttgcggcaatcggcgcctttttgtggtgctttgtttttattacaatcggaagggttatagggattattcatgtttaatacggctgtaaagattctgtatcgatcattgatagagctgacgaatcatcgtctgtcatcctatctgattaaaggattttgcgagtcgaaaatcagcaaaccggtcattccgcttttctcaaaacattttcggctgaattgggatgatgtggacggtacggctgctgattacggatcgctgtccgaattgttcattcgacaaataaatctggagcggcgccctgtgtcaaaagaggcgcatgcggtggtcagccctgttgatggtgtggttcagacggtaggaatcatcaacccgaatcaaacctttacggtgaagggaaaagattactcattcgctgagctgaccggctgtaaaagcgcagaccatcaatacaacggcggttacttcgtcgtgctgtatctaagcccgaggcattatcaccgtttccattctccgatcagctgcaggtatcaaaagctggccgagctcggaaatcgctcatacccggtaaatcaactaggcttaaaatacgggaaagatgtgctgtcgaaaaattatcggtttgtgtacgagctgaatagcggcagccgaaatgtcctgatgattcctgtcggcgcgatgaatattaattctatcgtgcagacgagcacccgtgctgaattggagatcggcgaagagctgggatacttttcatttggctcaaccgtcattttgatttttgaaaaagacgcgttccagccgtccgcccatttagcagaaggccaagaagttcaagtcggagaactgataggttacgaagagtaagaagaggagcttgcataaacgcagcgcctcttttttttgaagaaaggtgagacttatggagaaacaaatcatcagctggattacagattatcagaacaccggagatgaagccgtcctgcggcaagtgcgagaagtgtgctggccgatcgttgaagcggttttgcaagagaaggcaatagatgatgaacaagcgaacaatttgcgcgaaaaaggaatcgagcggtttccattcatcatcagcaaataccaagcggatgtgcagcttccggttgagacatttttacgaaatacgtatcggttttactttcatcaggtgatgagagaatccagctaaagcttctttcaacagagaagctttttttgttggcaggaaaaggaaactttttctatatctatctcgtaatgactagagaacctagcagaaaaggagagatagaattgaaacgaatgatagtgagaatgaccctgccgctgctgattgtctgtctggcgttttcttctttttcagtctctgcacgtgctgcttctgaagaaaaatattgggattcatggattgaacgacatgcacagccactggatgcttccaatgcttcaaacaaagaccttcgatttctaaagaaggtgctgaaagggaaacgaatcgttcagttaggggaaacgacacacggcgctggtgaaatcaacgccacaaaggtcagaatgatcaaatatctccacgaagagctgggatacgatgtattggcatttgagtctggctttcctgatacaaatgcatcctaccttaatatggaccaattaacccctaaaagcacgatgaaaaactccatttacgctgtatggcacacagaagatgtcgttgaattgtttgattacatgaaagagcaaaaagagaaaggcgatccgctgatccttaccggttttgatattcaaagcatgaagaattcattcaatgatgctgcgactcattgggtaaaagcggtggaccctgagaaagcagagttgctctcccaatcagaaaatgatttttcaacattagtgacagacagcaatacgtttgatgaattttcgcaaaagaaggaaaagcttgtgaaaaactatcagaagctgatcaagttcactaaaacacatgcttcagagctaaaagaaaaccttccaaaagagccgaaagcttatgagatgtttatgcattctcttcagctgagaattgacgtaatggaaacgtatatgctggaagaaatgaaagaaaaactagaggagtatccggagaatattgaggatttttcattctttatgagagaccgcatgatggctgaacaatttcagtgggtagctgacaccctttatccgaaaaagaaaatcattgtctggggccacaattaccatctacgcaaacagaatacgaagatgataaaggactgggtacagctaaacggccctaacatgggtgattatttgccggagcagctgaaaaaacaaacatatacgattggcatttatgcttactcaggtgcgagtcttgatagctccgataataagactgttaagccggttacaagcccgccgccgtctgagagccttgaagctttgctgaaagcggcggaccgaccggctgtttttgttgattttctccatacaaaaaacaagaaaggcacttcgtggatgtataccccccgcacagcactctattggggattcacagaagagcagatgatccttaaggaacaatatgacggtgtcatttggctggagcatatcacgccatctgtcattatcaagtgagcggtgtcccctgtgctataacaggtggagttcaccttttgtttgatagttttcagataactacattgattagtaaatgaatggaaaatacttgtgtgccgtgagaaacccttgtgccgcttaggtttgtaagagcttggatatttttatcagtctgggcggatctgttcatctttgcggcattttcctgtatgatatagtaagagtgtgcatagcaactaactataattgaacagggtgtttaaaacatggaaaaacaatacagagtattactttactataaatatgttccgattgaagatccagaggcgtttagagagcagcatctggctttttgtaaggagcttggtttgttaggccgtatccttgtttcttctgaaggaattaacggtacggtatcaggtacggtcgaacagactgaaaaatatatggaaacaatgaaagctgatcctcgttttgcggacatggtatttaaaattgatgaagcagaaggccatgccttcaaaaaaatcttcgtccgtcataaaaaagagcttgtaacgcttcgtcttgaagatgatgtcgatccgaacgaaacaacaggccagcatttgaagcctgcagaattttatgagaagatgcaggatccaaacacaattgtcatcgacgcgcgtaacgattacgagtatgaccttggccatttcagaggtgcggtccgtcctgacatcgaagccttccgcgaattacctgaatggatcgaagaacacaaagatatgcttgaaggcaaaaagattttaacgtactgtacaggcggcgtgcgctgtgaaaagttctcaggatggctggtgaagcaaggctttggagatgtagcacagcttgacggcggaatcgtgacatacggaaaagatccagaggtgcaaggcaagctttgggacggccagtgctacgtatttgatgaaagaatcagcgtgcctgtcaaccgtgtcgagcatgtgattgtcggcaaggactactttacaggagaaccgtgtgagcgttatgtgaactgcgcaaatccatcttgcaataaaaaaatgatatgcacaccggaaaatgagtataaatatatgcgcagctgcagccacgaatgccgcacgaacccaagaaacctgtatgtgaaagagcataatatgacagaagaagaagtaaacgcaagactggcagcgattgaaacagaagatcacgctgctgctgaataaaaaaagaacacctcgtattgaggtgttctttttttctatatgctttcagtttggctgtttgcggaaacccattctttttggcggaaggccttttcccattttgataccacgatacaggcgatcgcatgtcccggtacgttcacgcccgttctcgccatgtccatgacgcggtcaacacccgcgataatggcaacgccttcagccggcagtcctacagcattggcagtcgccagaagaactacaagcgatcctgagggtacagctgcaatgcctttactggtcatcacaagcacaagcatcatgagcagctgctgggacaatgtcatgtctacttgaaaggcctgtgcgagaaagatacaagaaactgataaatataagctggagccgtcacagttcaatgacaagccggagggaacgacaaatgataccactcgtttgggacagccgtatttctccattctatccatcagctgagggagaatggtttcagtgctggtggtggaaaatgcaattaaaaacagatcccatatcattttcaatacttcgaaatacttaatctgaaagatgagaccgacaagcggaaagaggacaaagaggatcaggaacaggccaaggaatacggtgccaaccagcttaaacatagggaggaggagttcaatgccatattggcccacagaagcagccatcagggctaacacgccgataggagcagtgaccatgacgatttgcgtgagcttgaacataatctgagcggtagattcaaagaacttcattactggttcagaagctttgccgataccagcggcggcgacaccaaataaaatggcgaagaaaataacagcaagcaaatcatttctggccatgacatcaataatgtttgtagggataatatccaggatcatttgcttgaaatcaacaactttgtctgtgtagccggaaagttcatgaatatctttttttgccaaatgggagaggtcaagcccgacacctggttttaagacattcgctaataaaagtccaagccctaataccaacgttgtaatcacttcgaaccaaatgatcgtcttgataccgaggctgcccatttttttcatgcttccgcttcctgcggctccaatgacaatggtagaaaacacaatcggcacaacaatcattttaatcaggcggataaatccatctccgacaggtctcagtgccatcccgaaatcaggaaaaaagtggccgatcaatgcgccgacagccaaagcgattaaaatttgaaacgcgattaattttttcaaatgaatccccctttagaacgatagaatttaggcatattcatatcattcgtgattcaaatgcaaacaccttttttcaagttattttattttgacagcgctttcattatgttggcgaaaaagtcccccgcagcagggggacttttttacttcatttgaatgtgctttagatcttcttcagaggtatttgtgaaaataaccggtgttatggctgaagcggcatgctgcttgatgtaatcgagatcaagggtgagaagcagttcgccttgtttgacggcttgtccgcttgtgacatgtgcttcaaagccttccccattcagtttgacggtatcaacgccgacatgaatcaggatttcagtgccgccggcgctcataaagccgatggcgtgttttgtcggaaaaatcgagacgatctcgccgtccgcaggtgcaacgacttttccttctgatggtataatcgcaaatccctcgcccatcattttttctgaaaagacttgatcaggcacatcccctaaagagactgtttctcctttaatcggataaataaaggtctcaccggaatcgggcttctgcggtttgtcagttaccgtgtccagcgtggcggcggtggcagggacgcctccggccatgattgttttgatgtcgtcttttaaggcatcggacttggttccgaatattgcctggaagttgttgttgacctccagcacacctactgcaccaagccgttttaattcatccttgctgacttggcttggctgatgaacggtcacacgaagccttgtgatacacgcatccaggttagcgatattttgctgtccgcccaaggcctgcagcacgtgaaaggcaagctggtcttttgcaactggagctttctcctcattctgacggtcttcatctgtctcacggccgggcgttttcaaattccatttcagaatcgcaaatcggaacaaataataataaatgaaagcaaacacgatcccgacaggaatgacaacccagccgtttgtagacagtccgtagttcaagacgtagtcaattccgccgcctgagaacgtatagccgtggcggacatggaataaatcacaaacgacaaagatgacgccggcaagaatagagttaatcaaatagagcacaggcgcaacgaacaagaaagaaaactcaaccggctctgtaattccggtcagcatagatgtgagtgccgcagaaatcatcacgccggagatcatttttttcttttccggacgcgcggtatggataatggcaagagcaactgccggcagacagaaaatcatgtaagggaaatcccccatcataaagcgcccggctgtcgggtctcccgcgaaaaaccttgtcaggtctccggttacggtgttgcctgttgatgggtctgtgtattctcccatcataaaatagaaaggcgtataaaaaatatgatgcaggccaaaaggaatcagcaaacgatagatcgttgcataaaagaacaggccgactgttgaatcggcaattaaactgctggctgcgttaattccgttttggatcagcggccaaacgaatgagaaaatgacgccgatcaccaatgaactgacggaagtaataatcgggacaaagcgttttccagagaaaaatccaaggaccggatgcagctcgattgatgaaaatcgcttatataaataggcggcgagaagcccgatgatgattcctccgaaaacccccatatcaatcaggtgctcggctccttcatacggaggctgaaggccgagtaattttcccatattgtcgagggtgacggttaaaattaagtatccgatgacagcggcaagtccggctacaccttctccgccggctaatccgatcgcgacccctacggcgaaaatcagcgggagattatcgaatacaacgccgcctgcatcctttataatagggatgttcagtaaatccttgtctccgaaacggagcaaaagacctgctgccggcaggacggcaaccggagtcatcaacgcgcggccaagctgctgcagaatttgaaatgcctttttaaacatgacagtctccttttattgttttatgagcatggtgcactctttaatttttgagctgctttataatcggcgataacggttacatgattgtgtttttgaagaatggaggctggtacttctgtcgtgacaggaccttcagccatcttttgaatagcgtctgctttttcctcgccgcttgctaaaagcacaatatgtttgctgaattccatgatggttttaatgcccattgaaatcgcgagtctcggcaccagcaccggatcaccgccgaagaatctggcatttgcctgtatcgtgctttccgagagcttcacaacacgtgtccggtcctcaaaatcagatcccggttcattgaaaccgatatggccattggcgccgatgccgagaatttggacatcaatgcctcccgcctggcggatgagatcctcgtatactttgcatgccgcctcaagctgcggattgtctccttgcgggatatgaatatgatcaggctgcatattgatatgctgaaaaagatgctcatgcataaaatggttataactttgcggatgagatggagagagaccagcatattcatccaaattaaatgtagtaacctttgaaaaatcaatttcgcctgcctgatagtctgaaatcaactgcttatacaagccgaccggtgtgcttcctgttgccaggccgagaacggcatctttcttagcttgtatttgttctttaataatggcagcgcttaacttacagagttcttcgtagtgctcggcgatcagaatcttcatgtgacaccccctcaaagagatagacaagcaccttatttgttatgaccaatttatgatacttgtcattacgaatttagcaccgcccttatcaaactgtcaatattaatttctgaaaatttgttataaaagaaggatacaaatctttcatattgggatggcaaatggtattatggtctcaattaaaaagaacggaatgcatacagaatggggagaatgaaatgacagctttatattctgttatcaagtttaaaatcattgagttaattaaatcgggcaaatatcaggcgaatgatcagctgccgacggagagtgagttttgcgaacaatatgatgtcagcagaacaactgtgagactggctctgcagcagctagagcttgagggatatattaaaagaattcaaggaaaagggacatttgtatcggcggcaaaaatacaaacgccgattccgcataagattacgagctttgcagaacaaatgagaggccttcgttctgaatcaaaagtgcttgagcttgtggtgattcctgccgatcactccattgccgagcttttgaaaatgaaagagaatgaacctgtcaacaagcttgtcagagtcagatacgccgaggggaacctttgcagtatcatacctcatatattccctggaaggcggcaccggggctggcacaggaggaatgcaccggctcgctgtttgaattgttaaggacaaaatacaatattgaaatcagcaggggcacggaatcgatcgaaccgattttaacggatgaaacgatcagcggccacttattaaccaatgtcggagcgcctgcgtttttatcagaatcccttacctatgataaaaatgaagaagtggtggaatatgcgcaaattattacccggggagaccgaacgaaattcaccgtagaacagtcatatcattcataaagcaatgtgttttaagaagggaatggtggttctatgtttttattgacgaatggaaaagtgctgtggggagcagtgattgctgcattcatcctttcaattgtattttacccttctctgccgacgcagatgccgattcattatgatgttgcgaacagtccgaatctgacggttaacaagctggcggggactgtgatgctgcctgttttgatggtggtgtttgcatgggcgcggaagatcaattggcaattagtgttcgcagtgtatattttgctgatttgccacattgtcgtcctttgtttagcggtctaaatcaaacagccagaataaaactggctgtttttctttaatttcagcttcatctgacaatgaatgtggtgtataatagctgatgatcctaaagaatattctgaaatttataggtgtgaagcggcgtattattaaaggaaaggctgtatactttttgcagctttaaaaagactgaatatttaaacaattatatgaaaggtgtgctgattagattgaataagcttattgaacgagaaaaaactgtatattataaggaaaagcccgacccgtcttccttggggtttggacaatattttacagattatatgtttgtgatggactacgaagaggggattggatggcatcatccgagaattgcgccgtacgcaccgcttacgcttgatccgtcttcatctgtttttcattacggccaggctgtttttgaaggattaaaagcatacagaacagacgacggcagggtgctgctgttccgtccggatcaaaatatcaaacggctgaacagatcgtgtgagcgcatgagcatgccccctttagacgaagagctggtgcttgaggcattgacgcaattagttgagctggagaaagattgggttccaaaggaaaaaggaacgtcactgtatattcgtccttttgtcattgccacagaaccgagtctcggtgtgaaggcatccaggagctatacatttatgatcgtgctttcgcctgtcggctcctattatggcgacgatcagctgaagccggttagaatctatgttgaagatgagtatgtgagggcggtcaacggaggagtcgggtttgcaaaaacggctggaaactatgccgccagtcttcaggcacagcggaaagcgaatgaactgggctatgaccaggtactgtggctggacgccatcgaaaagaaatatgtggaagaagtagggagcatgaacatctttttcgtcataaacggggaagctgtcacacctgctttaagcggaagcattttaagcggggttacacgtgcgtctgcgattgaattgattcgaagctggggcattccggttcgtgaagagagaatatcgattgatgaggtgtatgtggcctctgcacgcggagaattgacagaggtcttcggcacaggcacggcagccgtcgttacgcctgtcggtgaactcaacattcatggaaaaacggtgattgtaggagacgggcaaatcggggagctatcaaaaaagctgtatgaaacgataacagatattcagcttggcaaggtgaaaggcccgtttaactggacagtggaagtgtgaaaatcgaaaaagaacctgcccggagacaggttctttttattttgaatgagtcatatcagcagccggcaggcttttgcggtttttcacataatacattgcatagcaaatggccataaacggaacaccgcaatacagtgcgattctttgattcggatcaaaggcaatgccaatgacggaagccaggcataacagaaacgctgcaatcggcacgaacggatacaaaggggttctgtatttcaaatcagtaaccttgtttcccgcttcgatataacgttttctgaacatgaattgagaagcagcgatacccatccacacgacaacgacggcaaaaccggaaatcgacacgagcacaacgtatacagtgtctggcgcaaatacgctggacagcaacgacagaatgccgccgatcatgctgaacaccagcgcgttaaaaggggttccttttgacgtcagctttgcaaatgtcggatgaagcgttttttcttttgataaagaccacagcatccgggaagaagcgtagagtccggaattagccgctgacaggatcgctgtcaggataacaaagttcatgatatcggctgcgtatggtacaccgactctgtcaaagacagcgacaaacgggcttttgatgacacctgcatcttgaatcggaatcagccctgacagcacaaaaattgttccgacaaagaagagtgagagacgccagaccgttgttttaatcgcttttggtatcgtcttgtcaggatcaacgctttcaccggctgcgattccgattagttccgttcccgaaaaggcaaaattgacggacagcatcgtcatcaaaatcgggacaaatccatttggaaaaagcccgccttccgcggtgaagttggacagcatcggagcggcttctccgcctttgatcggaatgatgccgaacatggcagagccgcctaaaagaataaataatacaatggctaatactttgatgctggaaaaccaaaattctgattcagcgaaaaacttgaccgaaaatgcgttaagcaagaaaatgaacagcgcaaagacggcactccacatccaaaccgatgtatgggggaaccagcgctgcattaacaggccggctgctgtgaattctgatcccaatgccacggtccatgtcagccaatacagccaagcgaccgtaaatccggtgcccggccctatgtatttggctgcataggtgtgaaaggcgccggtcacaggcatggcgactgacagctcaccgaggcatagcatgacaaggtagacgatgccggccccgactaagtaggcaagtatcgttccggccgggcctgcttgctgaatggtataaccagagcttaaaaacagcccggttccgatgacacctcccaaggaaagcataaagaggtgccggcttttcatacttctctgaaagtttgtctcattcttgttgtgggcagagttcatctttttccaactttctatcggcgatttatttccttcctaataaaaaatctcatgtcaggaagtgacacgagactccggcgaaccggctttaagttagaatatacaaactattccgataagtcaagttgtttttaaagagcgggcccaagccgcaatttcttgaatatcttcgggttttgtccggcagcagccgccaatcagtctcgcccctttttcatgccaggtgcgggcgctcgccccgtaagattctgcgcatgctgcgccgttccacgtttttgtttccggatcatattgctcacctgaattcgggtagacaatgatcggttttgacgtgttcttttttaactcctctatcaaggaagggatatgctgaagcggcgtgcagttgatgccgagtgctgcaatttggcggtgttcatcaagccacgatgcgcagtcagctgcaggtgttccgtcactgatatgcaggccgtctttagcactgaagctgatccacgcatacgtttcaggaaattccttcaacagctgaacaatcgctttggcttcagtcagacacggaatcgtttcacatgccaaaacatcagctccggcttcaatcagcgccttcatccggggacgatgaaattcaatcagttcatcttctggtattgcgtagttgccgcgatattcagacccgtctgcaagataagcgccataagggcctacagaagccgcaatgatcggttttggccgattcaaacggttctcttcaagcgaccaaaattcatcgcgtgcttcagctgcgatgctgacggacaactcgatgagccggcgtgcttccgcttcgctcagcccgcgtgcggcaaagccttcaaatgtagactgatagctggcggtgattgcacaatcggcgcctgccgcgaaataatcagtatgaacttgtttaatcagctccggctcttccatcaggatttttgccgaccacagactgtcgttcaaatcacagcccttgcgttcaagctcggtcgccatggcgccgtctagcacaataagcgggtatgtatctaatatgtgttggataggattcatagaatgtactgatgccttctttcagatttttttgaaaaagatatgaaaatcgtaatggaggcttacgtgtttgtcaataaacgcaaaaagagaaaggtgttcagcccatatgtctgaacacccttttcttatgatatttgtttgttgtgcgtgtcagtctttgtgtctgaaaccggccagcactcaatgccattgtggtttttgagcacatctttataaaagaccggatccttgcctgcttttttctggcgtgtatagtctttcagcgccgtaaaaacgacctttgatagtaagaaaatcgcgattaaattcacgatgaccatcaaacccatgaacaaatcagcaagatcccagacgagctggactttggcaacacagccaaacacgatcattgccagcacgccgatacggtagacaaaaatcagttttttgcttttgttcaaaaagccgatattggtttcgccataataatagtttccaattagagcacagaatccgaataacaaaatcagaatcgcgagaaagcctgatgcccatgatccgacatgggagctgagggaggcttgtgtcaaggcgattccgctcagacccggagtatgataggcatccgaaaacaggatgataaaggcggtgcttgtacaaatgaccagtgtatctgtcagtacaccaaaagcttggatcagcccctgtttgacgggatggcttgttgtggcggtggcagcggcattcggtgcgcttcccattcccgcttcgtttgaaaagattccccgtctgacgccttgcatgagtgccgcgcccaaagccccgccggcggcctgatcaaaaccaaacgcatttttcacgattagcgcaagcacacctggcagctgcgtaatgttggtgaaaatgacgaaaaacgcaactccgatatacaggacagccaatacgacgacaatggattcagccagctttgcaatgcgcttgactccgccaaaaataatcgtgccgaatacagcaattaaaatgagtcccaatgtcaggcggtttgtgccaaacgcgttttcaaaggcaaggctgactgtattggattgaaccgagttgaagacgataccgaacgataaggtgattaacacagcgaacagcgcgcccatccaccttttgttcagccctttttccatgtaatacgccggcccgccgcggaagccgtttacatcttttactttataaatctgagccagtgtgctttccacaaagctggatgctgatccgataatggcgataatccacatccagaagattgcaccgggcccgccgagtgcaatggcgatggcaatgcccgtaatatttcccgttccgacacgggccgccatgctgatgcaaaaggcttgaaacggagaaatggtgtttttcgaccgggaagcagcaccttctcttaataccctgaccatttctttcagcatgcgaacctgtaaaaacttaagcctgaacgtaaaatagattcccagagaaaggagcaaaacaattaatagctttgaccacaaaagatcatttgcgatacccacgatatgttccaggatttgctgcatagaatcacctcttttttcatatttaaaaaatgctgagctcccactcctgcgccatatgcttcagcagcataccgccagtgaggctgttaccgtattcatcaatggcaggcccgtaaatgccgatgccgcatccggattgaaaaggctgttctcttctggcgcttggaggtaccagcgccatgatgccaccggagacgccgcttttggccggcacgccgacaaacgccgcatatttgcctgaagcgttgtacatgccgcacgtcagcattaatgccttggccaattttgccacatcttttggaatcacctgctcgcgtcgaatcggatgatacccgtcatgagcaaggatcaggccgatcaacgcaatatcttctgtggtgctttccatagcgcattgcttcaagtacacctcaagtgtttcttctacttcagcttctaaaaagtttgtttcttttaaatagtaggccagcgctctgttgcggtgggcggtttcccattcagaacggaatacttcctcatgaattctcggccgttttcctatcaaagtttccatcaccgagtaaagaaactcgagcttttcgtatgccgattctccgggaagaatcgaagcgatggtgagggcgcccgcgttgatcatgggattgaagggctttcccggcttgttgatttcgagccgaatgattgaattaaaggcgtcgcctgtcggctcgacatctacgcggtccagcacatagggaatgccgcggctcatgcaggcggcaataaagctaatcacttttgaaatgctttgcagggtaaaagagacgttccagtcgccggcgtgtatcatcgttccatcaggctccaatacacagatgccgagctgtgaatcattgacttttcctaaagcggggatatagtttgcgctttgtccattggcggcaaaagggcgatagtattcaacccaatcatgaagctgtaacgccgggtttatgtctttctggtgctcttttatcaattctttcatcgaattcctcctcactgatttttttcttaaaggactgaggtgtatcaaaacgaaggctaaaggggcgttaaacgctttcataatagcggaaggtataattactgtataatggagactacagaatcatacaaaatacgacaaaaacattttgaaaataagcagtaagatttataaaaacctcatgttctgggtcaaaagcaatttgcaggttttctcccgattccccaaaataaaaagcgaggatgtgatcaacataaaactggaacggtttattgaaaaagacggatatatactggccctcatgctgattacggtgccgctggccggtgaactgaaattttatcccctcaatgaagaattccgggtcagctttggggcaccggtttttttcttctttttatcgttgttgcggcaagtgcccgctgtgctgccgggttttctgactggagcggctgttttcatctttcgcgtctttctggaattatggggcggaggacacaatgggctgactccgattctgtatgatcaagcgtctggctttttcttttatatgacttacgcctgtctgttttccatattaaaggccaatcgtttccgtgaacggccgattatgctcggtttcattgggtttatgattgaagttgtgtcagattgtgtcgagctaactgtgcaatttctcatttttcatacggttgtcacgcctgagaaaatcactgacattgcggtgattgcgatttctcacacatttattgtgatgagcttttatagtgtgctgaagctgtatgaaacacaatcgagagaaaaacagacaaggcagcagcacgagcacatgctgatgatcgtttccaatttatatgaagaaacggtgcacctaaaaaagacattgaaaacgacagagaaagtgacaaacgattcgtatcagctctatcgggaaatgaagggcaaggatgttcagctgagcggcagaatcctgagactggccggagagattcatgaagtgaaaaaggacaaccagcggatattcgcagggctttcaaaactgatttcgaatgagagtttgagagattatatgagggcttctgatttgctgcagctcgtgattcgaatgaatgaaaagtacgctgaagcactagggaagcagattgatttttactgctcgatcgagggagagcatgacgaatatcacgtatttatcgtgctttcgatcattaataatctaacagcaaatgcggtagaggctatggatgaagagggaatggtcagcctgaggctccgtaagccaaatgagagtatggtagaattccaggtggaagacaatggccccgggatttccgagaaaatcggagacattgtgtttgacccgggctttacttcaaaatatgacgaatttggcacgccttctacgggtatcggactttcctacgtaaaggaaatcgtgacagagctagaaggggatatcacgtttgataatcagcagcggggagtggtgtttgccatcaggctgcctgtccggcatttgattcagaaagggtgaaccaaaagctatgcgtttttttattgcagatgatgaccgtgcggtgcggtcaattttaaggcagatcattgaggacgaagatctcggggaagctgctggtgaagcagacgacggaagccaagtggaagggcatatgctgcaatttaagcagattgatattttattaatcgatctgttaatgcccggaagagacggcattgagacgattcgtcagatccagaatacgtactccggcaaaatcgtaatgatctctcaagtggaggcgaaggaaatggtcggggaagcgtactcgctcggcatcgaatattttatccataagccgattaaccgcattgaaattgtcacggttctccaaaaggtgaaggagcggatcgagcttgaacactcgattggagccattcagcattctctaagccggcttgtcaatcggactgaacggaaagcgcgtccccagcagaagagtgacagcggtttaaaagaggcaggaacattcctgttgtccgagctgggcatgatgggagaaggcggcgcacatgatctcatggcggtcctgcagtatttagcagaacacgagcaatccgagccgcacgaaaaacaaagcccttcgctaaaacaaatattcacccaagtagcggtacggaagctgggcacaggggcctcacagacggaagtcaatcgcgaaatgaaagcctcggagcagcgtatccgcagagcgattattcattcgctgcaccattttgcttcactgggcacaactgatttttcgaatccaaaatttgaaacctatgcatccaaattctttgattttccggttgtcagccagaaaatgaaagaactccaatccaaggatgcaaaaccccttgcacctgctagaataaatatgaaaaaattcatccacgtgttttttttggaagcaaagcttttgcatgagacgatgaaacaaagaaggatataaaccaaacagccggctgacctggctgtttttttgctgcgcagaatcccggccggacagtgatttaccgcttttttataaaatatcagaaaataaagatattgacttattgtttatttgtcttacaattaaacaaaaggatatatgggaaggagcggatgtgaaagaaaaattaataatagcgcttacagatagaggctgtatacacaaataacaggaggttatgttgatgagccgtatcagaaaagcacccgctggaattttaggttttccggttgctccttttaacacacaaggaaaactggaggaagaagctctttttcaaaacattgagtttttgctgaatgagggcttggaagcgatatttattgcttgcgggtctggtgaattccaatctctcagccagaaggaatatgagcaaatggtggaagtcgcagtctcggcagccggaggaaaggtgccggtctacacgggggtgggcggcaacctcagcacagcgcttgattgggcgcagctgtcggagaaaaaaggcgccgacggctacttgatcctgcctccgtatttggtgcatggcgaacaggaggggctgtaccagtatgcgaaaacgattattgaaagcactgacttgaacgcgattctttatcagcgcgataacgccgttctctctgttgaacagatcaaacgtctgaccgaatgtgaacagcttgtcggtgtcaaagacggggtaggaaatatggatttgaatatcaacctcgtctatacgatcggcgaccgcttaggatggctcaacggaatgccgatggctgaagtgacgatgccggcttatctgccgatcgggttccactcttactcttcagcgatttcaaattatatcccgcatatttcgcgaatgttctatgatgcattgaaaaacggaaatgacgagcttgtgaaggaactctatcggcatgtgattctgccgatcaacgacattcgcaaacaacgaaaaggctacgccgtatccttaattaaagccggtatggaaatcatgggtttgaatgtaaggaatacagccagaccgcctgtcggcccggttgaaaaagatcattatcagcaattggaagcaattttgaagcaggcggctgatcgttttccgaaaaaagccgcgacggtttgaccagaaaaaacacgaaaggggcaatgggcatgtctgtgatcacggaacaaaacacgtacctcaactttattaacggagagtgggttaagtctcaatcaggcgatatggtcaaggtcgaaaaccctgccgatgtgaatgatattgtcggatatgtacagaattcaacagctgaagatgtggaacgtgccgtcgccgccgccaatgaagccaaaacggcttggagaaagctgacgggtgccgagcgcggccaatacttatacaaaacagcggatatcatggagcagcgcttggaggaaatcgccgcctgtgcaacgcgtgaaatgggtaaaacattgccggaagcgaagggagaaacagcccgggggattgccattctgcgctattacgccggagagggcatgcgaaaaacgggtgacgtcattccgtctactgacaaagacgcactcatgtttaccacccgtgttccgctcggtgtggtcggcgtgatttctccgtggaacttcccagtggcgattccgatttggaaaatggcgccggcattggtatacggcaataccgttgtcatcaaaccggcgacagaaacagctgtgacatgcgcgaagatcattgcctgctttgaggaagcggggctcccggcaggggtcatcaatttggtgacaggcccgggttctgttgtcgggcaggggcttgctgagcatgacggtgtaaacgccgttacgtttacaggttcaaatcaagtcggaaaaatcatcgggcaagccgctttagcgaggggagccaagtaccagcttgagatgggcggcaaaaaccctgtcatcgtagctgatgacgctgaccttgaagctgcggccgaagctgtcataacgggggccttccgttcaaccggccagaaatgcaccgcgacaagccgtgtcattgtacaaagcgaaatttatgagcgctttaaagaaaaactgctccagcgcacaaaagatattacaatcggagacagcttaaaagaggatgtctggatgggaccgattgccagcaagaatcagcttgataactgcctgtcatacattgagaaaggcaaacaggagggggcttcccttttaataggaggagaaaagctggagaacggaaagtatcaaaacggctattatgttcagcctgccatctttgacaatgtgacatctgagatgacaattgcccaggaggaaattttcggtccggtgatcgccttgatcaaggtggactcgatggaagaggcgctgaacatcgccaatgatgtgaagttcggattaagtgcatccatcttcacggaaaacatcggccgaatgctttctttcattgatgaaatcgatgccgggctggttcggatcaatgcagaaagcgcaggtgttgagctgcaggcgccttttggcggcatgaagcagtcgagctcccactcccgagaacagggtgaggcagcgaaggactttttcacagcgatcaaaaccgtttttgtgaagccgtaatggtgctggaaagaggcatgcgtctctttcccggctttatcacagccagcatatgattctctactttgaaaaggagaagatactatgaaaaaagactttgcgaatgttacaccggcgggcaaaaaaacgtccgtgcgctggttcatcgtgtttatgctgtttcttgtgacctctattaactacgcggatcgagcgacgctttccatcaccggagattccgtccagcacgatttgggattggactcggtcgccatgggatatgtcttttctgcctttggctgggcctatgtcatcggacagcttccgggcggctggctgctggaccgttttggttcaaagactatcattgcgttaagcatctttttctggtcgttttttacgctgctgcaaggggcgattggctttttctccgccggcacagcgattatcctgctgtttgcactgcgttttctggttggtttatcagaagcgccttcatttcccggaaacggcagagttgttgcctcatggtttccaagctccgagcgcgggacagcttcagccttttttaattcagcacaatacttcgcaatcgtcattttttctcctttaatgggctggcttacccactctttcggctggcattccgtcttcgttgtcatgggtattgcaggcattcttctggctgtcatctggctaaaaacggtgtatgaaccgaaaaaacacccaaaggttaatgaagctgagcttgcgtacatcgaacagggcggcgggctgatttccatggatgacagtaaaagcaaacaagaaacagaatcgaaatggccgtatatcaaacagctgttaacgaaccgcatgctgattggcgtgtacatcgcgcaatactgtattacgactctcacctatttctttctcacatggtttccggtatatttggttcaggcccgcggcatgtctattcttgaagctgggtttgtcgcttccctgccggcgctgtgcggatttgccggcggcgtccttgggggcattgtgtcagacatcttactcaaaaaaggccgttcactgacctttgcaagaaaagtgccaatcattgccggcatgctgctgtcttgcagtatgattgtctgtaactacacagattcagcatggctcgtcgttgtcattatgtcgctcgcgtttttcggaaaaggcttcggcgcattgggttgggctgtcgtgtcggacacgtctccgaaagaatgtgcaggattaagcggcggtttgttcaacactttcgggaatattgcctcaattacaacaccgattattatcggatacattgtcaatgccactggatctttcaatggcgcgcttgtgtttgtcggcgctaacgcgattgcggcgatcctcagctatttgctgctggtcgggccgatcaaacgggtcgtgttaaagaaacaagaacaagaccccgatcaatcgttgcctgtctaatatttatgaaagcgctttataaagggaggaaaatgcatgagttcaccgatacaagagcaggttcaaaaagaaaaaagatcgaatattccctcaatttctgaaatgaaggtgattcctgttgcgggacatgacagcatgctgctgaatctaagcggagcacacagcccgttttttacccggaatatcgtaatcttaacagacagcagcggaaatcagggagtcggcgaggtgcctggcggagagcatattcgccgcacactggagctgtcagagccgcttgttgtcggaaaatctatcggtgcgtaccaggcgatattgcaaacggtcagaaagcagtttggcgatcaggacaggggagggcgaggaaaccagacgtttgatttgcgcaccactgtgcacgccgtcaccgcactggaagcggctttgttagatttgcttggaaagtttcttcaggaaccggtcgcggctttgctgggcgaagggaagcagcgtgatgaagtaaaaatgctcggttacctcttttacatcggcgaccgaaatcggacgaccttgccgtatcaaagcgatgagcagtcagattgtgcctggttccgtctgcgccatgaggaagcgctgacgccggaggccattgtgcgtcttgccgaatccgcacaggagcgctatggctttcaggatttcaaattgaaaggcggggtgctgcggggagaagaggaaatcgaagctgttaccgcattatcgaaacgttttccagaggcaaggatcactcttgatccgaacggggcatggtcattagaggaagctattgcattatgcaaaggaaagcaagatgtgctcgcgtatgcggaagatccatgcggggatgagaatggctactccgctcgtgaagtaatggctgaattccgccgcgcgacagggcttccgactgcgacaaatatgattgcgactgactggcgggaaatgggtcacgcgattcagctccacgcggtcgatataccgctggctgatccgcatttttggacgatgcaagggtcggtgcgggttgcgcaaatgtgccatgattggggtttgacatggggctcgcactccaacaaccactttgatatttccctagcgatgtttacccatgtagcagcagcggctccggggcggatcacggcgattgatacccattggatctggcaggacgggcagcgattaacgaaacagccttttgagatttcttctggctgtgtcaaggtgccggataagcctggactaggcgtcgatattgatatggaacaagtggaaaaagcgcatgagatctatcggaaaatgaatttaggcggacggaatgacgcgatcccaatgcagtttctgatcagcaactgggaatttgaccggaagcgcccgtgtcttgtgcgataagtttgattgtaaatattgtcatatccgctattttgtcttacaattgaacaactgaagggagagttgttcgtgtacgaaggtttagaggatttgaaagtcgatacagtcaatcggaaaacattagccaagcaggtcatcgaacggattgtccatttattatcgagcggacagttgagggccggagacaaattgccgacagaaatggaactgatggacattttgcatgtcagcaggccggtgcttcgagaggcgctcagttcacttgaaacgctgggtgtcattacgagaaaaacacgagggggcacatatttcaacgataaaatcggcatgcagccgttttccgtcatgcttgccttggccactgataatcttccggctatcattgaagcgcggatggcgctagaactcggactcgtgacaattgccgcggaaaaaatcaatgaggaagagcttcagcgtttgcagaagacgatcgacgatattgccaacagcactgacaatctttatggtgaagcggataaagagttccatcgaattattgcgttaagcgctaataaccccgtcgttgaagggatgattcagtccctgctgattacccatgcgaaaattgacagccaaattccgtacagggagagagatgtaacggtcgaatatcacaaaaaaatctacgacgcccttgccaaaagagatccgtacaaagcacattaccacatgtatgaacatctgaaatttgtccgtgacaaaattctaaaaggaatggatgaaaaataatggtgagcaaccgcagttgaaacgtaagagctgcggtttttttaaaaccaatttagaaaacgcttactaagatatgaggagtgattttcatatggcgatgaacctcaggaagaaccaagccccctttacatcaaagtgcatgaaatagataacactgcgattattgtaaatgatggaggactgccaaagggcactgttttctcatgcgggctcgtacttgaagaggatgttcctcaaggccataaggtggccctcaccgatctcaatcaaggggacgagatcgtgcgttacggagaggtgatcggatttgctgatgagacgatcaaacgcgggagctggatacgggaagccctcgtgagaatgcccgctcctccggcgttagacgatcttcctctcgcaaacagagtgccgcagccgcggccccctcttgaaggctacacgtttgagggataccgaaatgcggatggcagtgcggggacaaaaaatatcctcggcatcacgacaagtgttcaatgtgttgttggcgttttggattatgcagtcaaacgaataaaagaagagctgctgccgaaatacccaaatgtcgatgacgttgtgccgctgcatcatcaatacggatgcggtgtggcgatcaatgcgcccgacgctgtcattccgatccgcacgattcaaaatctcgcgaagcatccgaacttcggcggagaagtaatggtcatcggattgggctgtgaaaagctcctcccggaaagaattgcctccgaaaatgatgatgacattctatcgctccaggatcaccgaggttttgcggcgatgatccaatccattttggaaatggcggaggaacggttaatcaggctgaacagcagaacccgggtgtcatgtcctgtttcggatctggttatcggcctgcaatgcggcggcagtgatgcgttttccggcgtgacggcgaaccctgccgtggggtatgcggctgatttattggttcgcgcaggtgcaacggttttgttttctgaagtgacagaggtgcgggatgccattcatttattaacgccgcgggctgtcagtgaagaggtcggacaatcactgatcaaagagatgaagtggtatgacagctatcttcggcggggagacgcagaccgaagcgcaaacccgtcaccaggcaataaaaaaggcggattatccaatgtggtggaaaaagcgttaggctcggtagcgaaatcaggcacaagccccatctccggcgtgctcggccctggtgaaagagcagagcaaaaaggcctgctgttcgcggcgacaccggcaagcgattttgtgtgcggcaccctgcagctggctgcgggcatgaatctgcaggtgtttacgacagggaggggaacaccatatggcctggctgctgcaccggtgctgaaagtatcgactcggcattccttatcagagcattgggctgatttaatcgatatcaatgccggccgaatcgcgacaggagaggccagtattgaagacgtaggctgggaaatcttcaggacgattttggatgtagcaagcggccacaaacaaacgtgggcagaccgttggggccttcataatgatttgtgcttgtttaatcctgctccagtgacttgattcatgtttttatagcgggaagatggaatatgctgtaaaatgaaaatcagcgtataggaaacggaggggttatagcatggcattcattagattccgagtgacacgaattcaatagtgaacaactctcgcctgaatgcgagagaatcgggatgaatccgcctatgtatgagcccttatatggttatcaaaaaagagggtggcgtgcctgcccttttttgtgccttcaagcatcccttctctctactgcaggccggagcatgagaaaggggaaatgggatgacaaaccttaacgaaaaacagcttatcactgagattgtcgggcttgcacgcagccaaggtttgacggttcattctgagaacgcgcaattgaatgaaaccggaatggactttcaagttgtatttgccaaggacgacacaggtatgccatgggtgctgcgaaaaccgcggcgaagtgatgttgtggaaagagcatctgcagaaggcataacgcttgcctttctccgcgcgaatctgactgctgatgtgccggattggagaattcatacaccggaattgatcgcctaccccatgttaaaagggacgccggctgctggaattgatttggaacaaaagcaatatgtatggaatatggatcatcagccgccgtcagacgactttgtccgcacacttgccgacatactggctgaattacatggcacggatcaaatatctgctgggcaatccggaatagaagtgataaggccagaagatttcaggcaaatgacagcagactctatggttgatgtgaagaatacgcttggcgtatctacgacgctttgggaaagatggcaaaagtggataaatgatgatgcatactggcctggtttttctgcactgatacacggcgatctccacccgccgcatattcttatcgaccaaaatgaacgtgtcacaggacttctggattggacagaagcgaaggttgccgatccagccaaggattttgttctttatcaaaccattttcggggaaaaagaaactgcccgtttacttgaatactataatcaagcaggcggccggatatgggcaaaaatgcaggaacacatttcagagatgcaggcggcgtatccggtggaaatcgccaagctcgctctgcaaacacagcaggaggagcacgttcatatggcgctggaagcactcggtgtaatatcggattaagaattgacttcatttcatgaaccaagtattataaactttacaaataatagaacggaacaacaatcgtgaggaagagcaagtacgcatcagaatggaggttcagagagtcggtggcaggtgtgaaccgatcctcccctgatgccgaatgggcttctgaattgctttgctgaacggatagtaggcgatgccgggtttctctccccgttaccaagagaggagtatcgaaacataggttttctgtacttagagtgaacggctgtatagctgttaataaaggtggtaccgcgagaccctcgtcctttgcataggacgggggtttttgtgtttcttaaaggaggtgacggccaatggacgatggctggtggtggcatagcagatgagttagaaaggaggatatcaaatggtcattgcaactgatgatcttgaggtcgcatgtcctaaatgtgaaagagcgggagaaatcgaaggaacaccttgcccggcctgcagcggaaaaggtgttattctgactgctcaaggatatacgcttctggattttatccaaaagcatttgaataagtaaaggagaaaagctgagctgagatgagagcagaagagcagagtaagattcgtgaggccgcagcaggtacgatttttttgctgatcggaacagtttgttttgcgtctaaatcgatttggataaaatgggcataccaaatgggtgctgagccagatgccgtgctgctatacaggcagctgctggctgttccgctgttttggctgatttttttaatataccgtcctccaatgccagacggtaagaaaaaaggagacctatggaaggcttgtggcgcgggagtgttttgtttttttctgtctcccttgcttgattttatcgggctgaaccatgtatccgcaatggttgaacgtatattgctgatgagctatccgttgtttgtgtttggattcaccgcgtgtcgtgaccggaaaaggtcctcaattcaggacctcttcgcagttctggcggtcatgtttgggcttttcttggcgctgggcggctggaatgctgagcttttccaggcgaatatgattggagctgtattcattttgttatcttcggccgtctatgctggttatcttgtcctttccgggcatctcgtccatcaaatcggggggatccgtctcaatgcatacgggatgacagctgctggagctgccatgatgctttacacagggatcaaatcggcggctggcatgaatacgccaatggcagcatatccgctttctatgtatggtttgttcgcggtaattgcagtcgttaccacagtgattccatttgtgctaatgcttgagggcataaaacgaatcggggcacagcgagccgccgccatttcaatggcagggcctatcctgacgattttctatggagctttatttctcggtgaacggctcgggcttattcaagtcattggatgcgctgccgtattctttgtcattacgggcatggaatacaggaagctgaaaacaggaaaaaaagaataatttatataaaacacacacgtttttcaattacaataagtgtaattacgtgtgtgttttttgattttgtaaaggttaggtgagaagatgcagcgcatattgcttgtagaagacgaccactcaatcagtgaaatggtggatcattatttaacaaaagaaggctttggaattgtgcatgccttcgacggagaagagggcatccggctgtttcagcagggttcatacgatttggtcctccttgatatcatgctcccgaagctgaacggcatggattttctgaaaatcatccgggaaaaaagcaatataccggtcttaatgatttcggcaaaagacggagaggtggacaaggcattgggactgggctttggggcggatgattatatcgccaaaccgttttcgatgattgagctgacagccagagtaaaagccgcgatacggcgggcgacgcaatattcggcagaggagccggctgtgaataaggtgatccggattcaccagctggcgatagatgtagacaatgtttccgttttgaaaaatggacaaccgctccagctgacgtcaacagaatggcagctgctgtgcttatttgcatcaaatcctaaaaaagtgtttacgaaagaacaaatctaccgttccgtttggaatgaagagtactttgatgatcagaacatcattaacgtacatatgcggcggctcagagagaaaattgaggatgacccctcctcccctcaatatattaaaacgttatggggcatcggttataaattaggagagttttagaatgacagtgctatgggtggccgctgtcatcgctctggcgtgtctgaatgtgattcaattcataatgaaaaagaagcgggacgggaatctggcttacacggctgaccagcttagctacatgctcagccgggattcggcaggacaaattttgcttcctacagacgatcatgcgctcaaaagcttgcttgttaatatcaatcttatcgttgagaatcgtcagcagatcagcgcccaatttgccaaaacagagcaatccatgaagcggatgctgaccaatatgtctcacgacctgaaaacgccgttaacggtcattctcggttatatcgaagccattcaaagtgacccgaacatgccggacgaagagcgggaaagattgctggggaagctccgccagaaaacaaatgaactcattcagatgatcaactccttttttgatttagcgaaattagaatctgaagataaagagatcccgattaccaaagtacatatgaacgacatatgcaaacgaaatatcctgcactattatgacgctgttcagtcaaaaggctttcaagcagccatcgatatcccggatacgccggtgtatgcgcaggcgaatgaagaggctctggacagaatcctgcaaaacctattgtccaatgcgattcaatatggcgcggccggcaagttaatcgggctgacgctgtcttatgatgaaaggaacatcgccatcaccgtatgggatcgcggaaaagggattagtgaaaccgatcagcagcgggtgtttgagaggctgtacacacttgaagaatccagaaataaagcatttcaaggaagcggactgggtttaaccatcacaaaacggcttacagaaaaaatgggaggcaccatatccgtcaaaagcaagccgtacgaacggactgcatttacgatcacattgaaacgcatgacatattaatcgtaagaatttcttaaggtttgagaaataaaaatgacagggctcgccgctacaatagaaaacaggaaaagagagggaaggagaaacaaagttgacttatatcgtacaaacaaacgggctgaccaaaacgtatcagggcaaagaggtcgtatccaatgtcagcatgcatattaaaaaaggtgaaatctatggctttctcggcccgaacggcgcggggaaaacaaccattatgaaaatgctgacgagccttgtcaaaccgacaagcggtgaaatcatcatccttgggaacaagttcacccacacgtcatatgaggtgctggggaacatcggcagcatgattgaatatccgattttttatgaaaacctgacagctgaagaaaatttagatctgcattgtgaatatatgggatatcacaataaaaaagccatacaagaagtgctggatatggtgaatttaaaacaaatcgacaaaaaacccgtcaaaaccttttccctcgggatgaagcagcgccttggaattgcgcgtgccatcctcacgaagccggacctgctcattttggatgagccggtgaatggtcttgaccctatcggcattaaaaagatcaggcaattgtttcaagtgctgagcaaagagtacgggatgacactgctgatctcaagccacctgctgggtgaaatcgaacaaatcgcggacacaatcggcgtcattcgggacggcaggctgcttgaagaggtatcaatggaggatgtcaggggccagaacactgaatacatcgagcttgttacatcgaatcagacaaaggcctgctttgttcttgagaaagagctgcaattaaccaactttaaaattttaaatgagaaaacaatccgaatttacgaagccgaagcctcacagcctgctatatccaaagcgctgattttaaatgatgtagacattgaatcaatgaacaaaaagtatacgtcgctggaggattattttatcaaattgatcaacggcaatagcatcagtgcgtaaaggaggagagacacgttgatgaatttgatcagaatcgaattaagaaaaatgaaaatgggctggtatatcagaggtgccctcattgccaacgtgatcattatgggttttatgtggctgatcagttattccgaaaaagccgatggcggggtttcgttccaaagtacggatgaagcattcctcatcatcggcaccttcgtcagagcggtatttatcgtatttggcgctgtgctgatcgtaaaattggtgatttcggaatataaaaacaaaaccattcttgtgatgttcacgtacccgatcagccgtaaaaagctgctcaccgctaagctcatgatcgcgggcggactgacgtttatcacgattttactttcaaatatactcatagccaccggtttcttttggctgaactcgatctaccattttataccagtagagcttactttcgagatcatttctcaacaggcggtcaaaatggcggttttcgcttttggcgccgctggaaccagtttagttcccatcttttttgggatgcgtagacactcggttccggcgaccatcatttcatctgtagtaattgtgatgctcatcagctcaacaagtccgggcttctcgatttcatctgttgtgtatatcccgttatcgttagcggcattcggattgttcttttcctacatggcgatcaggaatgcggacaagcaggatgcgtaaacaaaggcgcccaataagtataaaaggccaatgctgtcagcaccggcctttccattatgagtctgttcttgtttcaagataatgcttcttgccaatctctttgctcatcatatagaaatggaagcaatattcaccgattgccatgacgatcgcgccgaataaagccgccaacgcaacttcaccgccagtcatccccagggaaagcggcatgcccatcagccagatcacaagaaaggccaagccaaaatcagccaaagttgcaatcatattattccatctcggcaatacatacagatcgcccagcaaataagaaataacccctaacactatcgtcattaacagcgtatctccaaacgtgaaaccaaagcccagaccaagcaccagatacaacacaataatcgtcataatacctttaatcgcgagcgctttcacatgtgtcattacaattcctccttttgtcatttgatttgttatgtataattcctcaaatgtaaaaagttaaaccttatttcttttcggaggcgggtgcaaatctgctggggaggggtcgatgatgtgaatcaggaattgaggctgcggcgcttcgacagcggaaacgtgaagcttgtaccgcaccggacgctgctttgacgcccaacagcccattatgttggctgtttttagatgaataaatttaaaaacttctcctgtccctccgtcatcacttctgaagtaatgaaatatgatgaaaagagatcaaggggaggtgacgtgatggcggtcgtgagagcaacgagtgcggatgtcgatctgatggcaaggctgctcagagcggaagcggaaggcgaaggcaagcaggggatgctgcttgtcggcaacgtaggaattaatcggctgcgggcgaattgctcagattttaaaggcctccgcaccatcaggcagatgatttatcagccacacgcgtttgaggctgtgactcatggatatttttatcaaagggcgcgagatagcgagcgtgctcttgcacggcggtcgattaacggtgaaagacgctggccggcaaaatttagtttgtggtacttcaggccggagggagactgtccagcccagtggtataaccagccgtttgtggccagatttaagtcacactgcttttatcagccgacggcggagacgtgtgaaaatgtatataacacattttagagacaggacaccgttcaaattgaacggtgtttttatttgaaaagatgcaatgggaaatattcctgtgagataatcgaagaaaaaagagctgacggagatgacagaatggcaacaattgacctgcaaaagaaaagtgtaaagatcgtactggagaaaaagcagttaacgaaggtgacggctcgtgtcggactggttcttgatattacgggatcgatgagaccgctctacaaaaacgggacggttcaaaatgtggtggagcggattttggcagtggctgatcagtttgatgataacggtttgctggatgtatgggtgtatgataatgaattttcccgattaaagccagtttcagaaaaggatttttcgggctatgtcgatcgtgaaattttaaataatgaccgcttgcataaattcggcagaaatgatgagccgccagtcatgaaggacgtgctgcgcaaatatgttgcggaggaaccgagctcgtatcctgctttcattgtttttatcaatgacgggggctgtaaaaagtcaatcaaaccgataattaaagcttcttctgataaaccggtgttctggcagtttgtcggcatcggaaacggaaactttgattttctcaataaactggatacgttagaagggcgtgtcgttgataacacgaacttcctgcatatcgaagagattgaccgcatttctgatgatgagctttatgatgctctgcttgctgaatttccattttggctaaaagaagcgaaggaaaaagggattgtaagagaacaagagcctcctgctgaaaagccgaaaaagaagggctttttcagcagattgttttcgaaataactgataaggcactgagtcattctgcgaaatggctcggtgtttttgtttttttaagatcatgtgaagaaaaatagtccgaatgggcggcttgcaaacgacaggatatgcagaaaacgcgtcattcagccagctttcggcatgtttcagcggcaggcttgtgagggaagacctgtttttgatgttcagcgcttacaatcggttcacacttcttcacagtcgtttaacaatgatttcctataatggagacgatcaatgaggagagaggggatcttgaatggcatacgacagtcgttttgatgaatgggtacagaaactgaaagaggaaagctttcaaaacaatacgtttgaccgccgtaaatttattcaaggagcggggaagattgcaggactttctcttggattaacgattgcccagtcggttggggcctttgaagtaaatgccgcgcctaaattctcaagctatccgtttacattaggggtagcgtcaggtgatccgctttccgacagtgtcgtgctttggacacgcctggcaccagatccgctgaatggcgggggaatgccgaagcaagcagtgcctgtcaaatgggaggtcgcaaaggatgagcatttccgtaaaatcgtaagaaaaggcactgaaatggctaaaccgagtcttgcccattccgttcatgtggaagcggacgggcttgagccgaacaaagtgtactattaccgtttcaaaaccggccatgaactaagccctgtcggaaaaacaaaaacactgcctgcccctggcgccaatgtgccgcaaatgacctttgcatttgcttcctgccagcaatatgagcacggatattatacggcctacaagcatatggcaaaggaaaagcttgatctagtcttccatctcggtgattacatatatgaatacggtccaaatgaatatgtatcaaaaacaggcaatgtccgcacgcacaacagcgcggaaatcattacgctgcaagactatcggaaccgtcacgctcaataccgttctgacgccaatcttaaagctgcacatgcggcattcccttgggttgtaacttgggatgaccatgaagttgaaaacaactatgccaataaaatacctgaaaaaggacagtcggttgaagcattcgtgctccgccgcgcggcagcataccaggcatactatgaacatatgccgctccgcatttcctctttgccgaatggcccagatatgcagctgtaccggcactttacgtacggaaacctggcgtccttcaatgtgcttgatacccgccagtacagggacgaccaagccaataacgacggcaataagccgccttctgatgaatcgcgcaatccgaatcggactctgcttggaaaagaacaggagcagtggctcttcaacaatttgggcagctcgacagcccactggaatgtgctggcgcagcagattttctttgccaagtggaatttcgggacaagcgcaagcccgatctacagcatggattcgtgggacggctacccggctcagcgcgaacgggttatcaatttcattaaaagcaaaaatctgaataatgttgtcgtactgacaggtgatgtacacgcaagctgggcatcgaatttgcatgtcgatttcgagaagacaagttcaaaaatattcggagccgaatttgttggaacctcgatcacttccggagggaacggagcggataagcgggcggatacggaccaaattttaaaagaaaatccgcacatcaagttctttaacgactatcgcggatatgtccgctgtacagtgacgcctcaccagtggaaagccgattatcgggtgatgccatttgtgaccgagccgggcgcagccatttccacgcgggcttcattcgtttaccagaaagaccaaaccgggttgagaaaggtatcatccacaacaatccaaggcggggtgaagcaatccgatgaggtcgaagaggatcgtttctttgcgcacaacaaagcccacgaaaaacaaatgattaagaagcgggcaaaaatcacgaattaaggagtggaaattatgttttcaaacattggaataccgggtttgattctgatcttcgtcatcgccctcattatttttggcccttccaagctgccggaaatcgggcgtgccgccggacggacactgctggaatttaaaagcgccacaaaatcacttgtgtctggtgatgaaaaagaagagaaatcagctgagctgacagcggtaaagcaggacaaaaacgcgggctgaatgctgatgaggcagacaccgggtctgcctctttttttatgaaagggagggcttttttgaatggataaaaaagaaacccatctgatcgggcatttagaagagcttcgccgccggattatcgtcaccctcgcggcattttttctatttctcatcacggcttttttgttcgtacaggacatttatgactggctgatcagggatttggatggaaagctggctgtgcttgggccgagtgaaatcctctgggtgtatatgatgctttccggcatttgtgccattgcggcttctatccctgttgccgcgtaccagctgtggcgtttcgttgcaccggcgctgacgaaaacggagcgcaaggtgacgctcatgtacataccaggtttatttgcgttgtttttggcgggcatctccttcggatactttgtcttgtttccgatcgtgctcagctttttgactcatttatcctccggccactttgaaacgatgtttacggctgaccgctactttaggtttatggtgaatttgagcctgccgttcggcttcttgtttgagatgcccttggtggtgatgtttttaacaaggctgggcatcttaaatccttacagactggccaaagcgagaaagctttcctattttctgctgattgtcgtgtccatattgattacaccgcctgattttatttctgattttctcgtgatgatcccgcttcttgtcctgtttgaagtgagtgtcaccctatcggcgtttgtctacaaaaagaggctgagggaagaaacagcggcggccgcttagtgcagcgtaccgcccggtgacttcacatcctcatcatattgtgcggccgtaacagcggcgattctcaatgcccggacaatcgtgtccaggctgaggctcggcgctgttttgtcgattgtttgctgcggaatgtaaggaatatgaataaaaccgccgcgaatgtgcggggatgtccggctaatgtgatccattaacccgtagaacaaatagttgcatacaaaggtccccgctgtgtatgaaaccgcagctggaatgccgtgttccttcatcttagcagtcattcgtttcacgggaagccctgtccagtaagcggcgggcccatctggagaaatctcttcatcaatcggctgatgcccttcgttatcggggattcgcgcatctgcaaggttgatcgccactcgttccggtgtaacctgcatccgtcctcctgcttggccgacacaaattacgatatccggctgatgtgtttgaatggcttggcgcagagtgtccagagcggatctaaagacggttggaatttgttccgctgtaataatggcttcttctgtctcgaagccattaagccgtttcgctgcttcccatgatggattgacggtttctttgtcaaaagggtcaaagcctgtgatcagcactttttttctcatcttctcatctcctttttcttttattctattgtttatttatgggtttttcatcaaaataatgtaaaggagtgaatcataatggagcatttgccgcagcagtatcgtcatttattcccaaccttgcagatgcatacgatgcttgccagctgttctcagagcgctttggcagagcctgtatcaagggcgatccaggattatcatgacagcctgctgtatatggggacgaactggaaagaagcaatcgaaaaaacagagtttgcgagaaacgagtttgcaaagctgatcggggctgaaccggatgaagtggcgattgtgccgtcagtttctgatgcgctggtttctgtagcatcgtccttaactgcatttggaaagaagcacgttgtatatacagatatggattttccggcggtgcctcatgtttggcaggcacactccgattataccgtatccgtcattccatcaatagacggtgtgctgccgctcgaacaatatgaaacgcatatttcggatgaaacagtactgacgtgtgttcctcacgttcattatcgtgacggctatgttcaggatataaaagcgattgccgagatttctcagagaaagggctctttattgtttgtagatgcttatcaatcagccgggcatattcccattgatgtgaaggaatggggcgtagatatgctggcggcaggcacccggaagtatttgctcggcataccgggtgtggcgtttctttatgtgagaaaggagctggctgacgcactgaaaccgaaagcatcagcttggttcggcagagagaacggatttgatggggcttatgcgaaaggcgcgcgtcgttttcaaacgggcaccccagcttttatcagcgtatccgcagctgtagcggctttatcgctgctgaattatattggggtttctcatatccgggatcatgtgaaaacgatctgtgtcgatgcagttcaatatgccgctgaaaaaggcctgaagctggcggcgggacaagaggggattcagccgggcatggttgcgatccgggatgagcgggcatcggaaacggcggcgttgctgaagaagaaaaaagtgatttgcgcgccgcgggaaaatgttatccgtctcgctccccatttttataatacgaaggaggaaatgcggcacgcgattgatgaaatcgcggcgaaaacgatccacaagtaaacataaaaaaagcccctgaacattagtcaggggcttttcatattaatgatctaccttcacgcgcttcataaagaaagcgccaattaaaccgataatggcaacaatcattgcaaacacaaatgcgtgctgtacacccgctgtcaaagcttgcgggatgactgccggatcggcagggtttttaactgtactcatataatcatgctggcctgcagccataatgctgaccgcaaccgctgttccgatagcgccggccatttgctgcagcgtgttcataatggcggtgccgtctggataaaattcacgcggcagttggtttaaaccgtttgtctgtgcaggcatcatgatcatagaaatcccgatcatcaagcaggtgtgcaggatgataatcagcacagctgttgaagtggtcgtgacatttgagaagaaccatagtacaacggtgacaatcacaaatcccggaatgacaagccatttcggcccgtatttatcgaacaagcggcctgtaacaggggacataaatccatttaaaataccgcccggcaagagaacaagaccagatgcaaatgcagtgaggactaagccgccttgcagatacatcggcagaagcagcatagatgacagaatgaccatcatacaaatgaacaccatgatcacacccaaaataaacatcgggtatttgaacgcacggaggttcatcatcggctgcttcattgtcagctggcggattgaaaataggataaggccgacaacgccgacaatcagcgacacgataacagtcgggctggaccatcccccggagccttcacccgcgttgctgaatccgaacacaatgccgccgaagccaatcgtcgacaggatgatagacaatacatcgattttcggctttgtcgtttcagatacattctgcatgtatgcgataccgaacacaagcgccagtacaaggaacggaagagagatccagaaaatccagtgccagttgagatgctccagaaccaatcccgagaaagttgggccgatggcgggcgcgaacataatgacaagaccgattgttcccattgcggcaccccgtttatgaggcgggaaaatcaccaagattgtgttaaacattaggggcagtaaaagaccggttccaagtgcctgaacgatccttgccgctaataaaaacgagaagctcggcgcaagcgccgcaatgaatgtacctaaaattgaaaagataagtgacacggtaaaaagctgtcttgttgtgaaccactgcaacagcagtcctgaaacaggaacaaggataccgagtacaagcaggtagcccgtcgttaaccattggacggttgccgctgtaatgttcaattccttcataaggtcggttaacgcaatattcagcgctgtttcactgaacatgccgataaaaccggccaacagcaaggaaatcataatcggcatcactttgtattgctgagatgctttagctgttgtttccaaaatcatttcccctctctatcaactgcatgtagtatgtcgtttttttatctcttcagcaggtcaggaatgcagctggagatatgaaggagcggcgtactgttttttgccgtcaaagataaaaggatgccgccttcaatcatcgcgttaaccacagtgctggcttcttttgcacggctctcgctgcagccagtctgccgcagtttttcctcatacacagaggcccattctttgtaggcttcatgacaggcttcgcgcaacggttcgcttttcaatgacgtctcagccgctagcaagcccacaggcaagccttcaatgtcttccgtacatgaaaactggcaggagagctccttcaaaaaggcttgaatgccttccgctggatcggtataggcttccatgcagtccgcgattttctgacggatatactccttcatctcattcacggcttcgatcgcaagctgttctttacccccgggaaagtggtagtaaagagagcctttaggcgcgccgctttcctttataatctggttcagccccgtgccgtaatacccttgcagctgaaaaagccgggtagctgccgaaaggattttctcacgggaatctccataactcataacattcccaccttactgaattgcaatcaaaaatatagtgactggtctattatcttgattcaatcatcaattgtcaagaaaaattcattgtatgaaaagacaaaaaaagaaggatatgacaacaaaaaatactgagagaaaagctgactgatcttttgactgaatagataaaatgttcaatgattaatcatcatatggatgtaaggagagaaatagatgaaaaaacaacgaatgctcgtactttttaccgcactattgtttgtttttaccggatgttcacattctcctgaaacaaaagaatccccgaaagaaaaaacgcagacacaaaaagtctcttcggcttctgcctctgaaaaaaaaggtctgccaaacattagaattttagcgacaggaggcacgatagctggtgccgatcaatcgaaaacctcaacaactgaatataaagcaggtgttgtcggcgttgaatcactgatcgaggcagttccagaaatgaaggacattgcaaacgtcggcggcgagcagattgttaacgtcggcagcacaaatattgataataaaatattgctgaagctggcgaaacgcatcaaccacttgctcgcttcagatgatgtagacggaatcgtcgtgactcatggaacagatacattggaggaaaccgcttattttttgaatctcaccgtgaaaagtgataaaccggttgttattgtcggttcgatgagaccttccacagccatcagcgctgatgggccttctaacctgtacaatgcagtgaaagtggcaggtgcccctgaggcaaaagggaaagggacgcttgttgttcttaacgaccggattgcctcagcccgatatgtcaccaaaacaaacacaaccacaacagatacatttaaatcagatgaaatgggctttgtcggaacaattgccgatgatatctattttaataatgagattacccgtaagcatacgaaggacacggatttctcggtttctaatcttgatgagctgccgcaggttgacattatctatggataccaaaatgacggaagctacctgtttgacgctgctgtaaaagccggagcaaaggggattgtatttgccggttctgggaacgggtctttatctgacgcagccgaaaaaggggcggacagcgcagtcaaaaaaggcgtcacagtggtgcgctctacccgcacgggaaatggtgtcgtcacaccaaaccaagactatgcggaaaaggacctgctggcatcgaactctttaaacccccaaaagcacggatgttgctgatgcttgcgcttaccaaaacaaatgatcctcaaaaaatccaagcttatttcaatgagtattgaagaaaagaaggcgaataagccttcttttttttggctttttaggaccaataatgacctatgaatcttaaaatttctttaaaaataagccaaaattaccctttacttaattaatttggtaacgtaatatatttggagaatttgttacaaaaaaaggaggatattatgaaatttgtaaaaagaaggatcattgcacttgtaacaattttgatgctgtctgttacatcgctgtttgcgttgcagccgtcagcaaaagccgctgaacacaatccagtcgttatggttcacggtattggcggggcatcattcaattttgcgggaattaagagctatctcgtatctcagggctggtcgcgggacaagctgtatgcggttgatttttgggacaagacaggcacaaattataacaatggaccggtattatcacgatttgtgcaaaaggttttagatgaaacgggtgcgaaaaaagtggatattgtcgctcacagcatggggggcgcgaacacactttactacataaaaaatctggacggcggaaataaaattgcaaacgtcgtaacgcttggcggcgccaaccgtttgacgacaggcaaggcgcttccgggaacagatccaaatcaaaagattttatacacatccatttacagcagtgccgatatgattgtcatgaattacttatcaagattagatggtgctagaaacgttcaaatccatggcgttggacacatcggtttattgatgagcagccaagtcaacagcctgatcaaagaagggctgaacggcgggggccagaatacgaattaatgaaaaacaaaaccttgaagaattctattcttcaaggttattctgctttcagcacaatggttttcgcagccatatcatgaacggtttgttttttcttcgtaaatgcggcagtcaaatagatcaggcgggagaacacatgcacccacgctatcaggtaacggacaatggcttgtgggaaggttatttttttatatgtttcgtccctcacgatttgcagcccgatgatttttttgcccagtgtgcccttccaatttgtcagcggcatcagcaaagggtacacaatcagcatcgatatggcgacaataatgacaccggcggacccatcaccaaacgtaaatccggctgccaaaatcactgctgcggcaatgattacatcaagtaaaagagcgcaggcgcgcagcatgaaaccagctagttccaatagaaacactccttaaaatgttaaataaatacctaatgattgtaaaaaagaagggcctaaagtgggaataggtgataagccttaaatcacaaaagttggtgaaaatgtcataggtaaattggcataatcagccagcttatcacattaccaaattcttttttagcccgaaaccaagccctcagaagttatttttgttaaaatagaaaagttacaacagaattcggagggtttattgtgggaaaagtgaaacgaaatgccccttgcccatgcggcagcggcaagaaatataaaaaatgctgcggaagtaaagttgtcgacttcccggcggaactagcggcaaaagaagcgaaacaaattcaggaagacttagtggagtatgccttcacagtacatagagaaagcatttcaggctttatcaaccagcatgaatttctttctgctatggacagacagacgaaagacatcagcgtatttaacttaggaatctggggaatcttcttccacccgcttgctggtgagaagacaatcttcgaagagtaccttcagaaaaaaggcgattcgatcactcgtccgaaaacgcgtgagatcgtagaatcatggcagagcatgacgcctgctttattgctgctgaaggacctgaaggaaggcatcattcactttgaagatgtcattacggcaaaacaattcgaagtggaaatggacgccagcaatcaagaccttcctccagtgggaagcctgattcttggatacccaatccacgaagcggaaaaagcagaattcttcatgcagttcacgatcttcccggtgaagagaacagaagcgctgatcagcaaggtgaagaaatatgcggatgccgctgtgaaggacggcaaaacgccggaggacttcatgaagcaggaattcaacaacgttctgttcgcgttgttagctgagaaagatgaagagccacaagcagagaaagcggaagtaagcactgttgagtgggcaaatgacttggagaaagaaaccgctgcggctattgaagaaggcatgagcggggaagagtatccgactgaattgatcccagctgttattgacatctggaaaacattctgcgagaaaaaatcacctgtcatcagaaagccggaagcttttgcggcggcagttgaatattatgtaaacgcgatttctcttaacggcgcgtccgtttctcaagctaaactggcgaaaaaatacggcgtcagcgcatcaacgatttccagccgttacaaagaaattgaaagcacgctgcaagatgaagcagatcgttttgcacaagcgttatcctcataatgaaaaaaaccttgaaaagccaggcttttcaaggtttttttatttctgaaacggaattttgatttctaaccggaagacggggtggcggtaggtaaaatccagcctgccaaaagcgcccttcaccagtttttgaatgatatatgtgcccatgccttcatgagcgccgtttttcgttgagcagccaaacgattgatagattgtatcgagcacttttgggtccatcccggagtgctgttttcacaagtcagtacataaagtccgctgcgcagtgaagtctcgagtttaatctctgctttttctcgggcctccgccgcgctgtcgagcgcattttctaatatgttgccgaccaagctgacctgatcagcaggcgaaaatggaagggaagaaagcggtgtatgcatatgcagcgaaacactcacattcgaggcgcgggctttttctaaaaaatcataaagcacccctgcaacgtacgcgttctctcctttcaaaaaacggtcatattgactgtattgatccgcccagttttgaatatatgcttgtgtatctgccttgggctgagctgatttgattgcagtgatatgtttcattgtgtcatgattccggcttctcacatcaatcagcatttgattggcgtgctgttcagcttgagtcagcttatcaatttgatcagaaagccttgcctgcaaagcagactgtccgatacggagcccttcacaccctgcaaatattacgattacacataatgcctgcatgatgtctgtgccgatcagcaccactcccgccgacatcacttgaatcacggcaatccatgcacaaagccctgaggaacagtgattccacacccgctttgtattccaaatgtacaatcctgcagcagctgcgcctaaaacagcggtgagccaagaggcggctgtgctatgtgaaaaagcagcagctccctgataacatatgaaactaaataaaaccagataaagacattgaaaaagggtaatcacgttctgaactcctcaaaagtagtagttttgaaaataatcaagctgctgcttggtgatcatcgcttttttagacgttccctcaaaggaaactgtgaatgaatgcttggtataagcggaaaaatgctttatgtaatgaatgttgataataaaggaacgatgcgaacgaagaaaatctttttcgggcaggtcgcctttaatatcatttaatgtttgatacgtttgcacctcttcggcggttgtcacaatcgtcgtcgaacgtcccgtccgttctgcgaaaataatatccttcttttgcaggacgtgcatttcagacttttgctttatcaatatacgcccattcaaactcgtttccgttttctttttcaagtagcggtcgaaggaagcggccagacgctcggcatagtacggcttcataatataatcatggacgttcaggtcaaaggcgtgaaccgcataaccgccgtggccggtaacaaaaatcacatccacatcaagtgaatgggatttgatcaaatcagcaagctcgtagccagatatatggggcatctcgatatcggcaagcagcagatcaatgtctccattctttacccgcctgtaggcttcctccgctgaatcggtggaaaagacaatttcgacgtcctgcattctggtcacgatcgcttccagcttctctaaatctactcgataatcatctacaagtccgacttttaccattatcattcccctagttacatagaatcatctttattctatcccatttcgcgacataaaaagaactcttcgcgacaactttatccaactaatccagcttttcgtatatagtcattactagaaataaagataagggagattgtgacatgattacactgaccgattgcagccgcaggtttcaggataagaaaaaagtagtcaaagcggtgcgagatgtaagcttaacaattgaaaaaggagaagtcgtcggcattctcggagaaaacggtgccggcaaaaccacgatgctgagaatgattgcttccttgcttgaaccatcacagggtgtaatcacagtagacggctttgacacggtcaagcagccggctgaggtcaaaaaaagaatcggtgtcttattcggaggagaaaccgggctttacgacaggatgaccgctaaagaaaatctccaatacttcggcaggctgtatgggctgaaccgccacgagatcaaagcaagaatagaagatttatcgaaacggttcggcatgcgcgattatatgaaccggagagtgggcgggttttcgaaaggcatgaggcagaaagtcgccattgccagagcgctgattcacgatccggacatcattttatttgatgagccgacaactgggcttgatattacgtcaagcaacatcttccgcgaatttatacagcagctgaaaagagaacaaaaaacgattcttttctccagccacattatggaggaagtgcaggcgctctgtgacagtgtcatcatgattcacagcggagaggtgatttaccgaggggcgcttgaatcactatacgagagcgagcgcagtgaggatttgaattacatctttatgtctaagcttgtcagggggatttcttaaatgctgagccatatttataaaaaagaaatgatcgacgctttgcgcgacagaaaaacgattttactcacaattttagtgccgatgattatgatgcttggacttgtcttcttttatgaaagcatgctgtccgacaaaggggagcagtacacgctggctgtcggccattcgcttccgcccgcactggaaagcaagcttaatgagattgacgaaatcagcgtaaaaacatttgcaaagcctgaagaggcagttgatgaaggaaaagcagatgcctatctgaacgtcccgaaagagttcgactcatatgtcaacagcatgacaccttttaagattgatgtttacggtaattcaatcgatcaagggtcgtcaaatgccatgcagcttgtgcagtctgccttagatcagtacaaaaatgaaattgtgcagcaacgtttaacaaataagcatattgatcaatcggtgatccagccgtttacgattcagcaaaaggaagcggatgaggagaaagggacttccgctattatgctttccgccattctgcccatgctgattctgacttccattgtttccggcgcaatgccgatcgctcttgatatcatggccggtgaaaaggaccggaagtcaatcgaggcgctgctattaacgccagtcagcagaaacaaagtgctggtcggcaagtggcttgcggtttccacttttgccgtggcttcaggtgtattggctttggtgtttttgattttgtccaccgtgttatttaccgaaaatttaaaaacggccttccagctgggagatcatatgtggagtgtaatcggcgcttcagccttaatcattgtgctctctgcattgctgatctctgcgatggagcttttcatcagcatcatgtccagctcggtaaaagaagcgcaaagttatatgtctctcgtcgtctttctgcctgtgttcccgatgtttttcatcttcagcaaggcaccgaaccaatttgacttatcatactttctcatcccgtttctgaacctgcatgcgttatttaaacagcttttattcgggatgattgacccggctgccattatgtctacggcgggaaccatcgccgtgctgatcgccatcttctttttactagccagagcctgcttcctgaaagacaaatgggttcttccaaaataaacttgcgaaaggagaaatacactttctcctttttgtatatcctgaaaaaagaaggaaaatagaaaaaggatatctaatacaaaaagtgaccctgcactatttttcatcaaaattggtttcaaaggagaaggaacaatggatcaaacacgtacactcggcaaaacgaagctggaggtgaagcggatcggattcggcgcgaatgcggtcggcgggcataatctatttccaaatctaaatgatgaaacagggaaggatttagtgcgcacggcattggatggcggcgtcaactttatcgataccgcctttatatatggattggggcgatctgaagaattaatcggcgaagtcgtacaggaacgcggcgtgcggaatgagctcatcatcgccaccaaaggagctcataaagaagtgaacggcagcattgaattagacaatagccgggagtttcttcgcagcgaggtggagaagagcctgaagcggctgaaaacagattacattgatttgtattatgttcactttccggatggaaaaacacctctcgctgaagtggcgggcactttgaaagagctgaaggatgaggggaaaatcaaagcgatcggcgcttcgaacctcgattatcagcaattgcaggattttaatgctgatggctatttggaggtcttccaggccgaatattctctcatacagcgtgatgccgagaaagagcttcttccatactgtgaaaaacaaggtatctcctttattccttactttccgcttgcgtccggactgctgacaggaaaattcacgcaagacacagtctttgatgatttcagaaaggataaacctcaatttcagggtgaaacgtttatccacaatctcaaaaaagtagataagctgaaagcagtagcagaggaaaaacaagcggatacggcacatgtcgccttggcgtggctgttaacgagaccggcgattgatgccattattccaggagctaaacgacctgagcaattacaggataacctgaaaaccttgaacattgaactgaccgaagatgaagtgaatttcatcagcgacattttcaaataaaaaggaaatagccgtcaaggctatttccttttggtgttttattctttgatgaatgcttcgactaattctgctgctctgtaatcatccatatcaagctgccattggtcgatgtcatttttcttcatttttacttcaactgttttttcagatgaagcaggtccaagctttttaaattcctcagggtagacttgaagcgcgtatttcactgcctcttcatagctggcactagagtttttactgtagtagtctttcactttgtcttcgatacggtctgaaagagaagatgcatctacaggtttaactgtggcttcaacaattgcttcgtctttagagattgaagtcgtttttgcttgaatggaagagtttttgcttaatccctctttaatgccgttcacgatattatcaagcgctttgctgtccgcatatgtgctggaaaggccggaagctgagagataaccgtctttggctgattcattgaaatcatttacaatttcatttttgttagcgccggtgattttttcgaaatcggcgttatctttgccgaaaagaaggacatcaacataagctgataacgcttttgcagaatcttggagcttatctgccgtcgccaggatttttttgtcttttccgtcaattttaaaagtaactgattttggctttttatcaccgtaagattccggcgtatagttgagctcgtattgcttgcctttatctacaacgaagaaaagatttccttcaacggatttgtcagcgttaatcgtgctgccttgaagcttttcgctatagtcttcagggtctgtgtcagacattttggtatcaccttgatacaatgtgaaatccatactgtctacattcagcgggtcttttcctgtgtttttcaccgcgacattgacttttaacacaagctggtcatctgaagtggacttatcatatttagacggaagtgtgtaagagacatccttgattttgacttgagctatatctgagcttttttctgtttctgattctttcttctccgcgcttgttttgctgccggaacaagcagctgtaaacatcatcagcagaagaattaggaaaacagcgtacgtttttttctgaaacattcatttttcctcctcaaatggtttaggaaagggagtcttttgtctttgagaaatggatctttttgaatggattagcatcatataaccaaaaaaatcagttcttttctcacggttttcaccggattttctggaaactccgccctcctttgtcatgaatggacctataaaaagttacaacggaattaattttaagattattagcttttatattgaataggttcatcatcctatttttggtgaaaaatgttctggtaaaactggtaaactcagaaaactgtgtattttagactattactttttgattagttgaagggaacataagaaggatgaaaggggctgcctttgtgaagaaaaaggaactgaaacaaaaagcattggaaatcggccgggtgccgacacacttaaaactggaaattgaagattatggcggtgatgataaaagagctcatttttgttgggcagatcctcaggatgagaatatcggcattatcgtggaacttggaccggacggggagctggaatccctttcccgtgatattgagcctgaaagcggagaaaggctgtctgaggagaaactagaggatatcatgcgccaatttgtcgagactcatcatccgggggcactctctgcctttgttcgtgaagaaaatgaccgtgcatacggcgataaagtgagattttcatatgttcaaatggaggctgggcttcctctccccatgagcggatttatggctgatgtttccttatcaggtgagattgtttacttccgttattacggcgaagcgggcagcatcatcaagccaaagcgggtcgcggatgttgaagaggcacttgcctttatcaagaaggacgtggagttcgaccttttgtttcaggttctccatcgttctgtttacaaaaacggagatgatcagccgcatttggtgtacgagcctgaatgtagggcgattaccgtacctgcggatttggttcaagaagaacaagcagttgatgatgacgatgattacagggagccggagagctttcctctccctttattcgagggcatccgcgaaaaggccgatcctgacagcatgattggtattgaaaaagggtttgtcaaagagcgggaagcggatttgggaaatgggagaatcggaatcgtttggcggaatccggatgaccctgtttatcagccggcggataaaagcatggacagctggtttaagggacggactcatcaagtgctgaaaaccatctatcacaaagaaaccggaaaactcgaaggcgtcatgtcatttatggagaaaaaagggccgctgacagtaactgaggcagagtgcgaaaaaatagcgcttcgctttctgtttgctttatttccgaatgccgatcaatattttaggatcagatacgatgaaaaggatgaagaagaaaacgcagtcgctggttttacgtttgaagcgcattgtcacggagttccgatccgatttgggcagatcagaatttgtgtcagccgccagacaggggatatcaccgtttatatgggaccggatattgacccaaataagctggcagccattgatcccattccggccatttcagttgaacaagccaagtctatcttttggcagcattttaaagttgagcttggctgggaaagagagtacggagatgatgaagaacacagctaccggctcgtctataagccggtgtatccgcgttttatcgatgcacatacaggagagcctgtcttcagctcatggtaaaacagccaaaagtcacgcaattacctcaggtatagaagagagtacgtgatgaaagtaacagaaagaatctcgaaaaacaatgacaataatagaaaaggacctttcttcactttaaaagaagaaaggtctttttatataataaacaggattctctttgtcgtagactctttgaaagggatgacttcattggttaataaacagctgaaaaagaaggcgcaggagatcggaaatgtaccgacacattatgagcttgagatagaagattacgaccaaaagcaaaagaagaacgggcaggcatattttatctggaaggaccctaaagatccggaaaagcacattacagttgaacttagaaatgacggcgctttgctcaccttttcaacaactgtccgctccgagacagacaaacaacttccagatgccgagctgaagctgacggctcttcagtttgccgctgccaatcatcccggcacatttatgaattttcattttcaaggcaaggaagaacgggggcagcacatccggtttgtctataccaaaatggagctggggcttccgattcccaattcaggctttttaattgatatgacacgaagcggtcagattgtccactttctatattacggggaagggtataaagccgaagttccgacggaatttgtagcaaaagagaaggttgtgtcccattacttaaacacaatgtcttttgagctgatgtacgatgtcattgatggcgagcaggaaccaaggcttgtttatgaaccgattctcccgggatacagctatcccgcagatgtagacgaaattgtgcccgaccagcatatcacagatgaaagaatagaaaacacggcgccactgccgccgcttcagaacaaggaagaagttgatatatttgccttgctgggttttacctctgatatgcagaaagtcagtgaaagagactttggggaacaaattggaagcacgtggcgcagaggcgctgcgccggagcgtaaggatttaagcataggaagctattttgaaacgagaaataaaaacacaatcaaaatgaagacggataaaagaacaggaaaattaaaagcagcgctttcttttatggagcggctgaacaaccgccaacgctccacggaagaatgccaagagatagcgcttcaatttttgtatgccctctatccgagagcggctgagtttttcagggtgaatcccgtccgaattgatgaaagagggagagtccgcaaccatttttctgtctggtataaaggagtgccgctgcggttcggcgctgcccgcatcattgtcaatccggaaactgggttgattgacgcttttatggcgcctgatattgaacctgaacaattggaagcgataaatcacaggccggatgtttccgctgaagaagcgagagaagcgtttttagccgcttttgatgtgaagctggaatggcagcctgactttactgcaggcagagaccagcactacaaacttgtctataagccggtttacccttcctatattgatgcgcacataaggaaaaagaaaaggctgtgaggggtgtctagttaggaatcatctccaagtgggggtagtccttgaatcgtttccaatccccgccccattcaaaaccgagtgtcttagcgatctcgacaacctccagccaatctgattttccgttttgattgccgtcatattccatatcccatatgatgcttccatcctttttttgaagggcgaaatcaatcgctaaaccatagttatgatacgattcccctcctcttgcataggtgacaatattccctttttttgtacgaccctgtttatataattcatcttgttccttaaaggacctgaatccttcagtaatgacgacggtaatgcctttattcgctgcagcgcctttgagtgcatcggcattctgcttcacaatcggatgaagatccgaggggacaggcatgtcctgcagggcgttttgagaatgccattcatgccgaatataactaaaacaaagatctagaagaaatagaatacataagatgacaaatgtttttgcgggtaacttcatatcggtctcactttctcaagatgtgctgaatgttagcgcttttaagtgattgactctctctaaaagcgaacagctatgataaaatataacataaatagtagcaggaggaaggaggcagaccgatgagagcaaagattccatcagaagaagtagcagtaaagctgaatgaatggtacaagctcattcgcgcatttgaagcagatcaagcagaagcgttaaagcaggagattgaatacgatttagaagatatggaagagaaccaggacttgcttttatatttttctttgatggaattccggcatcgaatcatgcttgataagctgatgccggtgaaagacagcgacaccaagcctccgttctctgatatgctgaacgaaattgaaagcaatcagcaaaaactcacgggcttattggaatactacttttattatttcagaggaatgtacgaattcaagcagaaaaatttcatattagcgatcgaccattataaacatgccgaggagaagctcgagtatgtcgaggatgagatcgaaaaagctgagtttctttttaaagtcgcagaagtgtattatcacatcaaacaaacgtatttttccatgaattatgcgagccaggcgcttgatatctatacgaaatatgaactgtacggtcgccgccgggttcagtgtgaatttatcatcgccggaaatttgaccgatgtgtatcatcatgaaaaagcactgacccacttgtgcagcgctttagatcatgccaggcagcttgaagaagcatacatgatcgccgctgcctattataatgtcggacactgtaagtacagtctgggtgattacaaagaagcggagggctatttcaaaacagccgccgccatttttgaggagcacaactttcagcaagctgttcaagctgtattttcactgacccatatctactgtaaagagggaaaatacgacaaggcagtagaggcgtatgaccgcgggataaagagcgcggctgaatgggaggatgacatgtacttgacgaaattccgcctcattcatgagctgtatcttggaagcggcgacctgaacgtgcttacagaatgctttgacctgctggaatccaggcagcttcttgccgacgccgaagatctgctgcatgatacagcggaacgtttcaatcagctggaacattacgagtccgccgctttcttttaccgcaggctgatgaatattaaaaagaagcttgctgagcagcgttttcaataggaaatggcagagaactacaggttctctgctttttttgtgctgttttcaactcggaaaaacagggtattttccactgcatagtgagaaacagaggaggatatcaagtatgtacaaagatttaaccggaaaaacagcgattgtgacagggtcttcaaaaggaatcgggaaagccattgcggaacggttcggacaggagaaaatgaatgttgttgtaaattaccacagcgacccgtctggagccgatgaaactctggaaatcattaagcagaacggagggaaagccgtcgcagttgaggcggacgtgtcaaaagaagaggggattcaggcgctcttggacacagccttagagcatttcggcacgctcgatgtgatggtaaacaactccggttttaacggtgttgaggcgatgccgcatgagatgagtcttgaagattggcagagagtgattgatgtcaatgttaccggaacctttctgggagcgaaagcagcacttaaccacatgatgaaaaacaatatcaagggcaatgtgctgaatatctcaagtgttcatcagcagattccgcgccctgtcaacgttcagtattccacatccaaaggcggcatcaagatgatgacggaaacgctggcgctcaattatgcggataagggaatccgcgtcaatgcgatagcgcccggcaccattgccacagaatcaaatgttgatacgaaaaaggaagagagcaggcaaaaacaattgaaaaaaatcccgatgaaagccttcggaaagcctgaagaagtggcggcagcagcggcttggctcgtatctgaggaagcaagctatgtgaccggcacaacacttttcgtcgatggcgggatgacactttatccgtctcagcttgaatagaacacaaaacagggggattgcgggatgaaaacagactggtggaaggatgcagtggtgtaccaaatttacccgagaagctttcaggacagcaatcgagacggaattggggatttgcgggggattatttcccgtcttgactacataaaggagctcggggcagatgtgatttggatttgcccgatctatccttctccgaatgttgattacggctatgatgtgacaaaccataaggcgattatggattcttacggaacaatggacgattttcacgagctgctggaccaggtgcatcagcggggattaaagctggtgatggactttgtgttaaatcacacctcggtcgagcatccgtggtttaaagaagcggagctggacaaaaacagcaaataccgcagctattattattggcgtcccggcacaaagaacggcccgccgacggactggctctcaaactatgggtgcccggtctggcaatacgaggagcacaccggagaatactatctccatatgaatgccgtcaaacaagctgatttaaactgggaaaatcccgaagttcgccaggcggtgtatgacatgatgaaattttggctcgataaaggggtcgacggtttgcgaattgatcagctccatctcatttctaagaaagaatatcttccttcgtatgaggactatatcaatcagcaggcagagccgaagccctttcagccaaatggcgaacgaatccatgactatttaaaagaaatgacagatgaagtgttttcccaatatgatgtcatgtctgtcggagaggtcggcagtgtcacaccggaagaaggcctgaaatatacgggaacagataagcatgagctgaatatgatttttcactttcagcatatggagcttgatcagcagcccggaaaagaacattgggatttgaagcccttgagctttctgatttaaaatcggttttgacaaaatggcaaaagaagcttgaacatcaaggctggaatacattgttttggtgcaaccacgaccagccccggattgtgtccagattcggagacgatggggaataccgcaaagcatcagcgaaaatgctggcagccgtactttattttatgaagggcacgccgtatatttatcagggagaagaaatcgggatgacaaacgcgccgtttacccggattgaagactacaaagatatccaaacgatcaatatgtatcataaacgggtgtttgaaaaaggctatgatccaaatgatgtgatgagatcgatcttagccaaaagccgggatcacgcccggaccccgatgcagtggaacagcggcaaaaatgccggatttactgacggcacgccttggctgaaggtcaatccgaacttcaccgcaatcaatgtggaggaagcgcagggagatcctgattctgtcttaatttattacaaaaagctgatcagcctgagaaagcagtacgctgacctcgtgaaagggagctttgatcttttgcttccggacgatccgcagttgtttgtatacatgagagaaaacagtaaacagcagcttttgtcggtcaataatttttcaaaagagcaagctgtttttcagtggcctaagaactgcggcaaagctcaggcctctctgcttctcagcaattataacaacaatgatcttgctgacgaaatggtgttccggccttatgagagcagggtctatcttctggacaaaacaaactaatgattgaagtagcccggcattcttagccgggtttttttagtacatatatccgctctgcaggcgggaagaataaatgaaaatgaaatttattcttgcaaaacgtaatgacttcggtttattatgatataggattacaaaatcgttatcattttgatttaaagttactgaaaaagaggggatatacgatatgtctaaaaaatggagcggtttgtttgtgattgcagcgtgctttttattagttgcagcatgcggcaactcatcaacaaaagggtcggcggattcaaagggtgataaactgcacgttgtcacaacgttctacccgatgtatgaattcacaaaacaaattgtaaaagacaaaggcgatgtggatctgttaatcccatcttccgttgaaccgcatgattgggaaccgacgccgaaagacattgccaacattcaggatgctgatttgttcgtttataatagtgaatacatggagacatgggttccgtcagctgaaaaaagcatgggccaaggccatgccgttttcgttaatgcaagcaaaggcattgatttaatggaaggctctgaagaagaacacgaagagcatgatcatggggagcatgagcacagtcatgcaatggatcctcacgtatggctcagccctgttctggcacagaaggaagttaaaaatattacggcgcaaatcgtgaagcaggacccggataacaaagaatactatgagaaaaatagtaaagaatatattgcaaaactgcaggatcttgataaactatatcgtacaaccgcaaaaaaagcggagaaaaaagaatttatcacgcagcatacagcttttggctatctggcaaaagaatacggcttgaagcaggttccgattgcagggctttcacctgaccaagaaccgagcgcagccagcttggcaaagctgaaaacatatgccaaagaacataatgtaaaagtcatttactttgaagaaattgcatcctcaaaggtcgcagatacgctcgccagtgaaatcggcgcgaagacagaagtgctgaatacactggaaggcttgagcaaagaagaacaggataaaggtttagggtatatcgacattatgaaacaaaacctcgatgccctgaaagattcactattggttaaatcataagatagtgtgcgccggaggggtgcacactatttctttgtgagaaaggaagattaacatgaatctcgtctcattgaaagatatcgttttcggctattcccatacgcctgttttagataaagtatcacttgatattgaaagcggtgagttcgtcggcatcactggaccaaacggcgcctctaaatcgacgctcataaaggtaatgctcggcatgctgaaaccgtgggaaggcacagtgacgatcagtaaaaggaatacagaagggaaacgcctgaccatagggtacgtcccgcagcaaatttcttcatttaatgccggctttccgagcacggtgctggagcttgttcagtcaggccgctatacaaaagggaaatggtttaaacgtttaaatgaagaagatcatcttgaagtagaaaaagcactgaaaatggtggaaatgtgggagctccgtcatcgtaaaatcggtgatttatcaggcggacagaaacagaaaatctgtatcgccagaatgctcgccagcaacccggatctgctgatgctggacgaaccgacgacagctgttgattacgacagcagaaaaggattttacgaatttatgcatcaccttgtgaaaaatcacaaccgcacagttgtgatggttactcacgaacaaaacgaagtacagcaatttttagataaagtgattcgattagagagaggagaaaaaggcggatggaaatgtttgacttggaattcatgcgacgagcttttctagcaggcggcatgatcgccgtcatggctccgatactaggagtgtatctcgttctcagaagacaggccttaatggctgacacactttcacatatctcattgtcaggtgttgccatcggcttttttctcagcaccaatataaccgcagcaagcatagtcgtcgtgaccatcggcgcgatcggaattgaatacatgcggcgggcgtatcggacttattcagaagtgtccattgccatcttaatggcagctggtttgtccttcgcgatgtttttaatcagcctttccaaaggcacagccaatatgagcatcgatcaatacctatttggatcgcttgtgacagtaaaccagcagcaggtctatattatcagtattatcacactgctgatcctgctttattttattgtactgagaaggccgctctacctgctgacgtttgatgaagctacagccaaaacatcgggaatcaatacaaacgttctctcgttgtcattcagtattgtcacaggccttgcgatttcagtcattattccgatcatcggggtccttcttgtatcggccctgctcgtattgccggcagccttcgccatcagaattgcaaaaggctttaacatggttttcattacagccatactcatttcattattcagcgtatttacgggactgacatcatcctatcagctcgggacgccgccaggtccgtctattaccctgctattgatcgttttgctattaatcggatttgcagttcagggagtttggacgtttatcaaaaaagaagctcagcgcaaaaaaagaagccgataacatgaaaagcagttttccctagggaaaactgctttttttatagaaacaattcggcaaggcgctcataagattcttttttcgcctcaaaatcaaacacattgcacagaaccatgatttcatttgtttcgtagcagcctgtgaggtctaacagctgttgtttgacagtggtgggagaaccgatcaccatccgctttctgttttcttctatgagttttttatcggacgctgtatagggatgagctttcgcttcctcgatgcttggcacgcggctgtccaagccttttccgacgcgaagaagccacagatcctggcttaatgcgagttcttctgcctcttcatctgtttttgcgcaaatgacaaaaatcgtaaacagtgcggatggattcgaaaaatgggctgagggccgaaagctttcccggtagatgcggaatgcattttctcctcgctcgggattaatgaaatgcccaaatacatatccaatcccctggtgcgccgcgcgtcttgcgctgttttcaccaagaccgagcacccatagctcgggtgccgtgtcaataaggggcgccgctttgattccggcatacggatggtcgggaggaagggaatctgttagaaaataagagacatcctgcagctgtctgttaaattcggttaagctttttttcaccccgtccgttaatgcaagtctggtttttgtcgtgccgccggggagcgaccgacgccgaggtcaatccggtttggatacagggcctcaagctggcgaaaggtttcagccactttaaatgggctgtattggggcagaagcacgccgcctgatccgacacgaatggtgtttgtctgtgctgcgatgcgggcgatcatgatttcaggcgctgtgcttgccagtcctttcgtgctgtgatgctcggcaaaccaataacgcttatagccccactcttcgctaaatcgagcaagctcaaccgaatgctgaagagttgtcacagggctctctcctttagaaacaggtgcctgatcaagtatgcttaaatgaatcaaaaggccgcttcctttctgtctgtttttagatggtgacacaagaataggcaaaatgacttgcccgcgtcaaatggtttgtttaagaagcgcactttatagcatttgcaaatcatatatcaaatatggaagttttttttcgaggtttttcgtcaattattcttaacttttacgaaactttgatataataacaaacgtatatattagtaatttacggcttattttccttgtgagcgtaaaaataaatgtgactatcttcacatttcgatgagtaggagtgaatcgtgtggcaatttctttagaaaaaggtcaacgaattgatttaacaaaaggaaaagccggtctgtcaaaattgatggtcggtctcggctgggacccagtgtcctcaggcggaggattcttcagcaaactgcttggcggaggcggtccgaatatcgactgtgacgcttcagtgctgatgctggaaaacggaaaattcaccgataagaaaaacctgatttatttcggcaacctgaaaagccgctgcggcggtgtacagcatacaggcgacaacctgacgggtgacggtgcgggcgatgacgagcaaattatgatagatttagataaaatgcctggaaacatcgataagcttgtatttgtagtgaacatttacgattgtgtcagaagaaaacaagatttcggcatgattcaaaatgcgtttatccgcgtagttgatcaatctaatcacgaggaaatgctcaagtacaatttgagagacaattacgccggcagaacaagcctgattacagcagaaatctaccgcagcggcagtgagtggaagtttgcggcgattggtgaaggcacaaacgatacgagattagaagatattatcagccgatacgtataaaagaaaaggagtggatgaaacatgacaatttcattggcaaaaggacaaaaagtagatttaacaaaaacaaatccgggtctttcaaaggttgttgtcggtttaggctgggatacgaacaagtatgacggcgggcacgactttgatcttgactcaagtgtgtttctgttagacgctgcaggcaaatgcgcgtcaccaaacgactttattttctacaaccaacttgaaggcggcaacggttcagtcgttcattcaggcgacaacctgactggtgctggcgaaggcgacgatgagaatgtaaaagtaaatctcagcgctgtaccggcaaacattgataaaatctcatttgttattaccattcacgatgcagaagcgcgcagccaaaactttggacaagtatcaaacgcgtttgtccgcatcgtaaatgaagaaacaaatgaagagctcatccgttacgatcttgcagaagatttctctattgaaacggcaatcattgcaggggagctttacagacataacggcgagtggaaattctccgcaatcggctcaggctaccaaggcggccttgcccgcattgcaacagactacggtttgcaagtcggttaagacaaatacgaagagcagaaaggagagaggcagtatggccattcaattatcaaaaggacagcgcattgatttaacaaaaacaaatccgggactgacaaaagcggtgatcggcttaggctgggatacaaacaagtactccggcggacacgattttgacctggatgcttcggcctttttagttgatgcgcatgataactgcgtaaatgatctcgatttcgtcttctataataaccttgaacatccgagcggcggtgtcatccatacgggtgacaaccgcacgggtgagggcgacggagatgatgagcagattatcgttgatttctcaaaaatccctgctcacattgagaaaatcggcatcacagtgaccattcacgacgctgaagcacgcagccaaaactttggacaagtttccaatgcatttgtccgcgttgtggatgaagaaacgcagaatgagcttcttcgcttcgatttgggagaagacttctccattgaaacagctgttgtcgtttgtgagctttacagacacggcggcgagtggaaattcaatgcgatcggcagcggattttccggcgggctggctgcattgtgccggaattacggtttgcaagtgtaagcgagtgacaaatagagaagtcaccgtttcaaattaataggaggaaaaaacttggactttttacatcatattttgtctacgtatgcttcatttttcgattggaaaatgtgggggaagttctgactgatcctgtttcctggggtttgatcggttcccttgttgttctggaaggtcttttatcggccgataacgcgcttgttcttgcggtcatggttaaacacctgccggaaaaacagcggaaaaaagcgttaacgtatggtttgtttggagcttatattttcaggtttattttcatcgggctcggtatgcttctcattaaattctggtggatcaaggtgcttggcgcgctttacctggcttggctcgtcattaagcacttctggataggcgaaaaagaagaggaagcggacggcatgaagaaaaactcttggatggtccgtacgttcgggatcttctgggcgactgtcatttcagtagaattaatggatcttgccttctctgtggacagcatcctggccgcgtttgcagtatctgaaaaagtatgggtgcttctgattggcggtatgcttggtattttaatgatgcgtacagtggcaaaagtgttccttgtgctgattgataaaattcctgagctggaaaacacagcattcgtcttaatcggcattatcgcgctgaaaatggcggggagcgctttccattacgaaatgccgcactctgtattcttcatcatcattatcgctgcatttgcggtaacattgatcattcactacatcaataaacaaaagcaggtgcgcgaacaaacagccgcttcaaaagaagaataaaacaaaacaaggagggaggttcaatgtccttccttttttgttaccgaaatatcgttcaatgacaaaccggaaaggaggatatgatgagacaagaagaactaaccattcataaagcacttccggctgatggcgattggaaaagcctgctgtttcagccattgccggagcgggatcactatgaaactgcacaaggcctttctttttctcgtcttgccggacagatattgggcacgcctattgatgagacggactactataacgagctgtatgagctgtctgtaaacgaccgcataacgattttgagtgaaacgcttgataaaacaatcgaaccggaaacatttcaaaagcttcagcatattcattccatcaatcagaaagaaaaagggctgtcagtcagccgctttgttgcctttctggacggggaaaagctgattgcgaagcactcaaatcccttgatgcaccgccatttaagaaaagcgctgatgacgcttttacatacctttgcggacagtcatgaaaaggggctgaatcatcctgattttcgcagagtgctgcttgatgtctcgaagttttccttaaaccatctgaacccttggctggaaaaaaccgatatagagcgggagatgccgaaggttgtttggtatggagatgcgacgaaaagccagctctatttcttatattatctgatgctagtcggctgtgatgtactactgttccatccggcgggaacggatcagctggcgcttgtcgacccgaagcaggagctcagttttacggaaaagctcccggatgtttcggagcttcagccgtttccgaaagaaaaacctgaccggaaatcaacagtggcttaccgctcaacaaaggaaattgaacatgtgctgaatcacgaggaatccatgctgtataagccgtggcagttcagagatcacacaccggtgtccgttacgctgaaaacgacctatgatgaattgtttttaatcacgaaagaacgcgcctttattcggccgaatttcaaagcagataaatattccattgagattccgaatgtattcgccaaaattatgggcgtgtcgaaagacaataaggaatattggaacaggcttcatactctagcggattatcaggaaacagaaatggtaagaagctttccatttacagaagaaataaagtcgaactatcaatttcactacagccacgcacttgatcaagaagggaacattgatccggacaagctgatggcaagcaatgtgtggcagtacaaacagctgccggcaggcgttcagactgccattgccaaaacgatttcgagaatgtgcaggcacccgcggcttaaggctttgcatcaggaacaagtcaaggatgttcaaatctatttgtttaaacaaacaacaaacctgcctgctaatctgctgaaattgattcaaatgttcgactatgcgcaaaccgttccgaaactcgttttatatcatacggaaatgagcggcggactcgcgcgttcggatgctgccgccctgctgttcctgaatgaaatcggaatcgatatcatcatttataatccgcccggacaccaagatattgagcagtttattgaagaggaccagtatgatatccactggctggatgacatggtgtttcagcaggactacaaagagccttcgcttgtgaaaaggctcttcagaaccattacccaaaaataaggagagaagaaaagcatgacaacagaaaatcaaaatccgcttgttctcgataaaaatgaagagatttcccagcaaaaagctgacgatatccgtcttcagctccgtcaggaaccagaagtgaagcggcttgctcaacaaattgacgtcaaaaaccaaatggagctgcttgagtacggcaaggagccggccgttgaaatatccaagttctctgaccgcatcttagggatgatgaaaacaacaagcgtgacagactccggcacaatgctgactcagcttgggaaaatcatggaccgcttcgacaaaaatgattttgatgagccaaagggattaatggcgaaaatttttaaacgcggcggcagcatgattgaaaaaatctttaaaaagtatcagacacttggcggagagattgaaaaaatccacgttgagatttcaaaatacaaagatgagatgacgaagacgaactacacgctcgatgaaatgtatgaaaacaatatcaaatactatatggagcttgaaaaatacgtcgttgccgggcagatgaaactggaagagatgcagtcgatccttccttcatatgaggaaaaagcggcaagcggaaaccagctggcgcaaatgcagctcgatacattgcgcaacggcattcaggcgcttgaggaacgggtgtatgatcttgacatggcacggatggtggcgcttcaaaccgcacctcaaatccgtctcctgcagcgaggaaatgcaaagctgatcgggaaaatcaactccgcgtttatcattaccattccgattttcaaaaacggcattattcaggctgttacggtaaagcggcaaaagcttgtggctgattccatgagcgagcttgaccgccggacaaacgagatgctgaaacgaaatgctgaaaacatctcgagccaaagtgttgaaattgccagaatggccggcagaccgagcatagatattgaaacgatcgaatcgtcttggaacacgattgtcagcggcatgcaggaaacaaaacaaatcgaagaagaaaacaagcgcctccgcgaagacggcgcgagacgaattgcccagcttcaggataatattaaaaaagcagcattgcagcaataataaaaaccccgcttgtggaacataagcggggtttttcaattacatcatttagttaatgacaatgtgtaaagacaggtgtaaacttaaacggtaatcattttgcatatcagaggtgttggcaatgggaaaacaacagcctatatcccagcgtaaactgctgggcgtcgccggtttggggtggctgtttgatgcaatggatgtcggaatattatcgtttattatcgccgcgctccatgtagagtggaatctgtcgcccgaagaaatgaaatggatcggaagcgtcaattccatcggcatggctgcgggtgcgtttttgtttggtttgcttgctgatcgaatcggccgcaaaaaagtgtttatcatcacccttttatgcttttccatcggaagcggcatttccgcttttgtgacaagcttatcggcatttctaatccttcgtttcgtgattggtatgggacttggcggcgagcttccagtcgcttcaacactcgtttcggaagcggttgtgcctgaaaagcggggcagagtgattgtgcttttggaaagcttttgggccgtgggctggctcgcagcggccttgatttcttactttgtgataccaagcttcggctggcaggctgcacttctgttaactgcgctgactgctttttatgcgctgtacctgcggacgagtctgcctgattcgccgaaatatgaatcgctttctgccaaaaagaggtcggtgtgggagaatgtaaaaagcatctgggcaagacagtatatacggccgaccgtgatgctgtcgatcgtttggttctgtgtggtgttttcttattacggcatgttcctatggctcccgagtgtcatgctgctgaaaggcttcagcatgattcaaagctttgaatatgtcctgctgatgacgcttgctcagctacctggctatttctctgccgcatggctgattgaaaaagcgggccggaagtggatacttgtcatttacttgattggcacagcaggaagcgcctatttcttcggaacagcggattccttaagtcttctgcttacggctggcatgctgttatcgtttttcaatctcggtgcatggggcgtgctgtatgcttataccccggagcaatacccgactgcgattcgggcaacaggttcaggaacgacagcagcgtttggaagaatcggcggcatcttcgggcctttgctcgtcggaactctggcagcccgtcatatttcgttttcggtcatcttttcaatcttttgcattgcaatcttactcgcggttgcttgtattttgattatggggaaagaaacgaaacaaactgagctagaataggaaaagcacctcttgaaagaggtgctttcagcgtgtcgacaaaccctcgcattcgttgtcaggactgcgcttcggtgctcaatgcgatgtggatcaacggctaaattctcaggcgtcctgcctaaacgccgtcgtcatcacatcctgtgaatgtccgctcctatgctcgtccttcctagacttcaagggttttcaatcacgctgaaaagatgacaaaatcctaaaatgaaaaccattttaggattttgtcaacaatctgaggcacctcttgaatgaggtgctatttttacatttgcgcccgggctgcggattggcgtttcccggttttagtgattgcctggtagagcgtcatagaaagtatgaacaaaatggcagtaaatcctgtgacagctccgaaatgctgtgtgctttgatataaaaaacctgcaatacttgtaccgacagtggtcccggcatacatagcggcattggaaagggaagcgatggttcctcgcgcatttggtgcaatggattgaaagacacccatcattaacggaaagatgatgccagctgtaaagaacgtgagaaaaaagccggcttctactaaaaacaagtttggaaagaacggaagagcgaaatagagagcgcccattagcagcatcccgctgatcagtgttttaaacatgcccagcttttctgaaacccggctgccgataaggctcccgagcatatttcccagtccgagtacaagcatagctgcgccaatttgtgacacggttaaatgataatccgcggaaagccaagtacccagaaagctgaacgaagcgaagtttccggtttgaaacagaaaataggcaagcagaatgaccgatgttttcggcaatgaaaaaagctcccgataggggttgacaattgatgggcgcgccaatggttcagaaggccggatatcaggcatgaccgccgccaggatcaatagaagaataagcgagcacgctgacaaaacgaaaaatggcgtatgccatgtaaaggaagcgagaaaccctccaataggaagtccgagcatttgtgaagcggccaaacctgctgtcgcaatccccatgccttttatgatctgagaagggtggacaatgactgggatggacgcccaaatttgaggcgtcacaaacgcagcgctaacgcctgcggcaaaacggaacaggcacatggcggcaaaagagggagcgatgccgcataaaaacgtggatacgataaagcctgcaagtccccacagcatgactgttttcctgttcagccggtctgagattgggcctgcaatgaaagcgaagagcgcataaccgagtgcataagcactgaccatccagcctgacaaatcagtagagacatgaaactgatcctgtaaaagggggagaagcggcgaaagcaaaaaggtatccgtgccaatgacaaacatgacactgaagaaaagccaaatgcgattcaaattttatcactcctattgttttataactttgaaactatgaaacagatatgtatagagaaaaccctttgttagagggtttccaaaaagccaggcaggtatgtgtgaaaggtgtcttcacgcagactgacgtattttgtccgcgaatctttccgggttgccgtcaatcccgcttcacgcagcgttttaaaatgataagatgccgtggttttgacaatattgcacttttcacctacttcaccgcagctgagttcttttccgctgacataaagcgtacgaataatggcaagccttgattcatcagacagtgctttaaaaatttgcgctctgatttgatcatctgattgtttcatagtcatgaaactataatacataattgatgttgaaaaagcaacttatttttccagtaaaggagagggaagtcataagaggaagaaggaattcaattccaataaaagcgttttcaaataaagataggcgaaaaatcacccgtaaaatacaatcatataggaggattacagagcatttagaagcataaataagatcatgtggtcacatggatgtttataaagaaatggtacagaataaaagagaatatgctgtttgtgtgggaagttacataaatgttacggtaataaagattgcttaatatggagggaaaatatgagtgtagatgagaaaccaattaagataaaagtcgagaaagtctctaagatttttgggaaacaaacaaagaaggcagttcaaatgcttgccaacggaaagacaaaaaaagagatcctgaaagcaaccggatcaaccgttggtgttaatcaggcagattttgaagtatatgatggtgagatatttgtcatcatgggtctatcagggagcggtaaatcaactttagtacggatgttaaaccggcttattgaaccgactgccggaaatatttacattgatggtgacatgataacaaatatgtctaaagaccagctccgggaagtccgccggaagaaaatcagcatggtcttccaaaagttcgctctgttcccgcacagaacgatacttgaaaacacagaatacggactggaacttcaaggtgtagacaaacaagagcggcagcaaaaagcgcttgagtctcttaagctcgtcgggctcgaaggatttgaacaccaatatccagaccagctttccggcgggatgcagcagcgtgtcggccttgcccgcgcgttgacaaatgatccggacatccttctgatggacgaagcgttcagtgcgcttgatccactgattcgtaaagatatgcaggatgagcttcttgatcttcacgataatgtcggaaaaacaattatctttattacgcatgacttggacgaagcgttgcggatcggcgacagaattgtcctaatgaaggacggcaatatcgttcaaatcggcacgcctgaagaaatcctgatgaatccatctaacgaatatgttgagaaattcgtcgaagatgttgatttgtctaaagtcctcacagcaggccacattatgaaacgcgctgaaacagtgcggattgataaagggcctcgcgtagcattgacactgatgaaaaaccttggaatttcttcaatttatgcagtggataaacaaaagaaattattaggtgttatctatgcgtctgatgcgaaaaaagcggctgagtctgatttgtcacttcaagacatcttgaatacagaatttacgactgtaccagagaatacgtatctgactgagatttttgacgttgtgtccgatgcgaatattccaattgcggttgtggatgagaagcaaagaatgaaaggaattgtcgtaagaggcgcgctgattggcgcacttgccggcaataacgagtatatcaacgctgaaggcactggcgaacaaacacaagatccttctgtacaggaggtgaagtaagatggatagactgcctagaatacctttagcagatatcattgaccgttttgttgactggattacgatgacgtttggcggattcttcgacggaattgcaaacggattggccgcttttgtaaatggaattgtcaccggtcttggatttattccatctattttgttaacgattattttcgccgcacttgcgtggtggatcagtacaaggggaattgcgttatttacgttgattggattcctcctgatcgattatttaggatattgggacccaatgctgcaaacattggcgcttgttttgacatctgtgattatttcgattgtggtcggggttccgattggaatttgggcgtctcagaaagaaacggttcgccgtattgtaacgccaattcttgatttaatgcagacaatgcctgctttcgtatatctattgccggcgattttcttctttaacatcggtgttgtgccgggtgttgttgcatctgttatcttcgcgatgccgccgacaatccgcatgactgttctcggtattaaacaagtgccggcggatctgattgaagcgactgaggcattcggttctacaacagctcagcgtttgtttaaagttcagcttccgcttgcaacaaaaacgattttggccggaattaaccagagcatcatgcttgcgttatcaatggttgttatcgccgcaatggtcggtgcaccgggacttggttctgaagtatatagtgccgttacacagctgaaaaccggggtcggagtagaggccggtatcgccatcgttatcgttgccattaccttggaccgtattactcaaaatattaaagtgaagaagaaaagcagggggaatgcctgatgcttaaaaaaatcatcggcatcggcgtttcctccatgctggcgctctcacttgcggcttgcggttcagaaaacgatgaaaatgcatccgcagcagaacaggtgaataagaccatcatcgggattgaccccggttcagggattatgtccctgactgacaaagcgatgaaggattatgacctgaatgactggacattgatttcagcgtcaagtgctgcgatgaccgctacgcttaaaaagtcatacgaccgtaagaaaccgattatcattacaggatggacaccgcactggatgttctccagatataagctgaaatatctcgatgatccgaaacaatcttatggcagcgcagaggaaatccatacgatcacacgcaaaggcttcagcaaagagcagccgaatgccgcaaagcttctgagccagtttaaatggacgcaagacgaaatgggcgaaatcatgatcaaggtggaagaaggcgagaaacctgccaaagttgctgctgagtacgtcaataaacacaaggatcagattgccgaatggacaaaaggcgttcaaaaggtgaagggagacaaaatcaaccttgcctatgtggcgtgggacagtgagattgcaagtacaaacgtcataggcaaagtcttagaagacttgggctatgaggtaacacttactcaggtagaggctgggccgatgtggactgcaattgcgacgggaagtgcggatgcatcactttccgcatggctgccgaatacccataaagcatacgccgctaaatataaaggcaaatatgatgatattggcaccagtatgactggtgtgaagatggggcttgttgttcctcaatatatgaaaaatgtcaactcaattgaagatttgaagaagtaatcaaaaaagcagcctgtgtcaggctgctttttttgcgttattttacgtaagcggcagcgggtgaatcagccttttgaaaagtttttaatacggcattcgctaaaatgtgaatgccgttgaacatcgcatttctgtcaaaggtcatgtgcggatgatggagccccggctggagcccgcagcctagtccgagcatcgttgttttcagattcggcaccttcacggcgtaaaaatggaaatcctctccgccggtagtgacaagcgggtcatcaagccgctcagccccgatgatatctgtaatggcttctgccatgatcgcttcagcttctttgttttgtgttgccgcaggaaggctgtgttctttttgtagctcgatttttgcgccgaatgcagcggcggccgcttcacaggctctttctgtttcggcgattaacgcctccatggcttcattggtctgtgcgcgcaaatcaaggctgaacgatgcttttcctggaatgatgttagagctttcaccgccggcttgaagttttgtcattttgacggtatgcgggatttgcgggtcaatatgaatgagtccgagcttatgtacaagaaatgccgcaatttcaatgctgtttttcccgaggtgcggacgggcgccatgagcctcttccccgatgatcgttccctcaatgtgctggcttgatccgtgcagaatagacggagcgcagcggccgttctgtgtttcctggatcggacggacgtgaacgccatacaaatagtcgatatcatcaagcacgccttcttctatcattttcaaggcgccgccgcctttttcttctgccggctgaaagataaaacggattgtgcccttcggaagctctggttgttttttgagcagcattaacgtgcccaatgccattgtcatatgtgaatcgtgtccgcaggaatggttggcgcgaaatgtgccgttaacctcctgccacagcgcgtcaatatcagcgcgtaccgctacaacaggtgagcctgagccgatttcgccgacaaccccggtgcagtctgaaaacgtgcgcgtccggcatcctaaatcctcaagcttttgtttcaaaaatgaagttgtctcatattccttccagctgacttcagggttcgcgtgcagatgctcgaagatgtccataatggtttgtttcatgtcttctgaaagcttttgcatggtaagaaatacctccttctatcagaatgaatttttaccttctttactttatttatattgaaacaggaagataggctgtatataatatagcacatattgctactattcagaataattaatattttcaaacagaggggatggatcgaaatatgagtatgccagcagccgaaacacagcctaagaaaaaacgtatgacatttaaaatgcctgacgcctatgtcctcttatttatgattgctttcatttgcgcaatcgcttcatatattgtgccggcaggtgaatttgaccgcgtgacaaagggggatgtcacgaccgctgttccgggaagctatcattccattgaacagtctccggtcagcttgatcagcttttttacttctctacaggatggaatggttggatcagcacccatcatctttctgatcttattcacaggcggcaccattgctattctagaaaaaacgggtgccatcaacggcctgatttacaatgtcatcagcaaattccgcacaaagcaattattatttatttgtattgtcggcgcattgttctccattctcggaacaaccgggattgtcgtgaattcagttatcggttttatccccatcggcctcattgtggcacgatccttaaaatgggacgcagtcgcgggagccgctgttatttacatcggctgctacgctggatttaactccaccatattatcaccgtcaccgctcggtttatcacaatcaatcgcggagctccctcttttttctggaatcggcctgcgagttttgatatacatatgctttttgctgtcttctattatttatatctatttgtatacgagaaaattaaaaaaatcaaaagatgccagtgtgttaggaacagattggttccctgcggcaggaatgggcgaagccggtaaagaagaagatcagtcagtgccgtttaccgttcgccataagctgattttggctgtggcgggactctcacttgtcggatttttatacggcgctttgaagcttggctggtcagattcccaaatggctgcgacatttatttttatttctgtccttgccggtttaataggcaggcttgcggcgaacgatattgccaaaaccttcattacgggctgccaaagtcttgtatacggggcgctgattgtcgggatggcacgaagcatttccgttatccttgaaaatggaaagctcctcgatactgtcgtcaatgctttggcttcacttttggacggattcagcccgattgccggggcaatcggcatgtatatcgccagtgcgctgcttcattttctcatctcttcagggtctggcgaagccgttgtatttattccaatcctggcgccgctcgctgatttgatgggaatcacgagacaggttgcggtggaggcagttatgcttggagaaggggtcgtcaactgtgtgaatccgacatccggcgttctcatggcggtgcttgccgccagcggtattccgtatgtcaagtggctgcggtttatggtgccgcttgctctgatttggttcttgatcgggcttgtctttatcgtgatcggcgtcatgatcaattgggggccgttttaacgattgctgcccgccggcttgtacggcgggcttttgagttattcattgcagaagcgcaggctgttattgtaacatgtaagccataagccattcgtaaaagtgcgggaggaaggtcatgaataatctgcgtaatagactttcaggcgtgaatgggaaaaataagagagtaaaagaaaaagaacaaaaaatctggtcggagattgggatgatagcgggagcatttgcgctgcttgatgtgatcatccgcgggattatgtttgaatttccgtttaaagaatgggctgcaagccttgtgtttttgttcatcattatcttatattactgcatcagggctgcggcatccggaatgctcatgccgagaatagacaccaaagaagaactgcaaaaacgggtgaagcagcagcgaatagaatcaattgcggtcgcctttgcggtagtggtgcttacgatgtacgacagggggattccccatacattcttcgcttggctgaaaatgattcttctttttatcgtctgcggcggcgttctgtttctgcttcggtatatgattgtgaagctggcttacagaagagcggtaaaagaagaaataaaaaagaaatcatcttgaaaaatagatggtttctttttttgtttggaaagcgagggaagcgttcacagttacgggcagctttttttataggaacattgatttgtattcactctgccaagttgttttgatagagtgattgtgataatttaaaatgtaagcgttaacaaaattctccagtcttcacatcagtttgaaaggaggaagcggaagaatgaagtaagagggatttttgactccgaagtaagtcttcaaaaaatcaaataaggagtgtcaagaatgtttgcaaaacgattcaaaacctctttactgccgttattcgctggatttttattgctgtttcatttggttctggcaggaccggcggctgcgagtgctgaaacggcgaacaaatcgaatgagcttacggcaccgtcgatcaaaagcggaaccattcttcatgcatggaattggtcgttcaatacgttaaaacacaatatgaaggatattcatgatgcaggatatacagccattcagacatctccgattaaccaagtaaaggaagggaatcaaggagataaaagcatgtcgaactggtactggctgtatcagccgacatcgtatcaaattggcaaccgttacttaggtactgaacaagaatttaaagaaatgtgtgcagccgctgaagaatatggcataaaggtcattgttgacgcggtcatcaatcataccaccagtgattatgccgcgatttccaatgaggttaagagtattccaaactggacacatggaaacacacaaattaaaaactggtctgatcgatgggatgtcacgcagaattcattgctcgggctgtatgactggaatacacaaaatacacaagtacagtcctatctgaaacggttcttagaaagggcattgaatgacggggcagacggttttcgatttgatgccgccaaacatatagaacttccagatgatgggagttacggcagtcaattttggccgaatatcacaaatacatctgcagagttccaatacggagaaatcctgcaggatagtgcctccagagatgctgcatatgcgaattatatggatgtgacagcgtctaactatgggcattccataaggtccgctttaaagaatcgtaatctgggcgtgtcgaatatctcccactatgcatctgatgtgtctgcggacaagctagtgacatgggtagagtcgcatgatacgtatgccaatgatgatgaagagtcgacatggatgagcgatgatgatatccgtttaggctgggcggtgatagcttctcgttcaggcagtacgcctcttttcttttccagacctgagggaggcggaaatggtgtgcgattcccggggaaaagccaaataggcgatcgcgggagtgctttatttgaagatcaggctatcactgcggtcaatagatttcacaatgtgatggctggacagcctgaggagctctcgaacccgaatggaaacaaccagatatttatgaatcagcgcggctcacatggcgttgtgctggcaaatgcaggttcatcctctgtttctatcaatacgccaacaaaattgcctgatggcaggtatgacaataaagctggggcaggttcatttcaagtgaacgatggtaaactgacaggcacgatcaatgccaggtctgtggctgtgctttatcctgatgatattgcaaaagcgcctcatgttttccttgagaattacaaaacaggtgtaacacattctttcaatgatcaactgacgattaccttgcgtgcagatgcgaatacaacaaaagccgtttatcaaatcaataatggaccagagacagcgtttaaggatggagatcaattcacaatcggaaaaggagatccatttggcaaaacatacaccatcatgttaaaaggaacgaacagtgatggtgtaacgaggaccgaggaatacagctttgttaaaagagatccagcttcggccaaaaccatcggctatcaaaatccgaatcattggagccaggtaaatgcttatatctataaacatgatgggggcggggcaattgaattgaccggatcttggcctggaaaaccaatgactaaaaatgcagacggaatttacaggctgacgctgcctgcggacacggatacaaccaacgccaaagtgatttttaataatggcagcgcccaagtgcccggccagaatcagcctggctttgattacgtgcaaaatggtttatataatgactcgggcttaagcggttctcttccttattgaggacaaggctagactggacttaccgaaagaaaccatcatagatggtttcttttttgttcataaatcagacaaaacttttctcttgcaaaagtttgtgaagtgttgcacaatataaatgtgaaatacttcacaaacaaaaagacatcaaagagaaacataccctggaaggatgattaatgatgaacaaacatgtaaataaagtagctttaatcggagcgggttttgttggaagcagttatgcatttgcgttaattaaccaagggatcacagatgagcttgtggtcattgatgtaaataaagaaaaagcaatgggcgatgtgatggatttaaaccacggaaaggcgtttgcgccacaaccggtcaaaacatcttacggaacatatgaagactgcaaggatgctgatattgtctgcatttgcgcaggagcaaaccaaaaacctggtgagacacgccttgaattagtagaaaagaacttgaagattttcaaaggcatcgttagtgaagtcatggcgagcggatttgacggcattttcttagtcgcgacaaatccggttgatatcctgacttacgcaacatggaaattcagcggcctgccaaaagagcgggtgatcggaagcggcacaacactagattctgcgagattccgtttcatgctgagcgaatactttggcgcagcgcctcaaaacgtgcacgcgcatattatcggagagcacggcgacacagagcttcctgtttggagtcacgcgaatgtcggcggtgtgccggtcagtgaactcgttgagaaaaacgatgcgtacaaacaagaggagctggaccaaattgtagatgatgtgaaaaacgcagcttaccatatcattgagaaaaaaggcgcgacttattatggggttgcgatgagtcttgctcgcattacaaaagccattcttcataatgaaaacagcatattaactgtcagcacatatttggacgggcaatacggtgcagatgacgtgtacatcggtgtgccggctgtcgtgaaccgcggagggatcgcaggtatcactgagctgaacttaaatgagaaagaaaaagaacagttccttcacagcgccggcgtccttaaaaacattttaaaacctcattttgcagaacaaaaagtcaactaaccgcaactttagagtaaagggctgattgtcaatgtgggagcagttgtatgatccgtttggaaacgagtatgtgagcgcacttgtggcgctcactccgattctcttttttcttttggctttaactgttttgaaaatgaaaggcattcttgcggcatttcttaccctagccgtcagtttcttcgtctccgttttggcatttcatatgccggttgaaaaagcgatttcttctgttttgttaggaatcgggagcgggctgtggcccattggctacatcgtcctgatggcggtgtggctgtataaaatcgcagtgaaaaccgggaaatttaccattattcggtccagcattgccggcatttcgcctgaccaacgattacagctattattaattggtttttgttttaacgcgtttttagaaggcgcggccggttttggtgttccgattgcgattagtgcggcgctgctcgtcgaacttggttttaaaccgttgaaagcggcggcgctctgcttgattgcaaacgccgcctccggagcctttggggcgatcgggattcctgtcatcacaggggcgcagattggtgatttgtctgctcttgagctgtcacggacattaatgtggacactgccgatgatctcatttttaataccattcctgcttgtattcttattagaccgaatgaaaggaatcaaacagacatggcccgctcttctggttgtgagcggtgggtatacagcggttcagacactgacaatggcggtgctcgggccggaattagcaaacattttggcggccttattcagcatgggcgggcttgccctcttcctccgcaaatggcagccgaaagagatttaccgcgaggaaggggccggcgatgctggtgagaaaaaggcataccgtgccgctgacattgcgaaagcgtggtctcctttctacattttaactgcggcgatcaccatctggagccttcctgccttcaaagcgcttttccaagaaggcgggctgttatatcaatcaacgctcctgttcaaaatgccttttctgcatcagcaaattatgaaaatgccgccgattgcgccatctgccatgccgttagatgcagtctttaaagttgatctgctgtcagcgactggtacagcgattttagcggcggtcatcgtgacagggctgttcagcaaaaagttctcctcccgggatgcctttgcttccctgaaggagacaggaaaagagctgtgggtgccgattatgacgatctgcttcgtgatggggtttgccaatctggccaacttcgcagggctcagctcttcaattgggttagcattggcgaaaacaggagacctgttcccgtttgtcagtcctgttcttggctggattggcgtgttcatcaccggttctgttgtcagcaataacgctttgttcggccatttgcaggttgtcaccggagcgcaaatcggtgcgggttcagacttgctgttagccgcaaatacggcgggcggtgtcatggcgaaacttgtttctcctcaatctatcgccatcgctgcagcagcggtaggccaaacaggcaaggaatctaaactgtttaaaaggacagtggcgtacagcctgattctgttattgatcatttgtatatggacgtttattcttgcaaggttaggagtgtaatagaaaaaagcagtacatgcccagcatgtactgcttttttatgttaatttgctttctttgtcatttcggctgttgttttcactctggcttttcccataaataaaatggtaaccgccgcgaggacaattggaatcaaagcgagcaaaaagacatacgtaatacttgatgacatcgcgtcaataatgcgattcaggatcgcatcaggaatctgggaacgtgttcccgcttggaatatctcctgcgggtcgccaatattttgcgtagcacctgatcccgctgagcctttcataccgctgaaggcgtcgctcagcttgttcgtgaatacgtttgtttgcaccgttccgaaaatggtgacgcctaaggtcatgccaaatgatcgcaaaaatgaatttgtagagtttgccgttccccgaaagcgaggttcaagatcattcatcgatgccgccggcagcagggagaagttaaagcctacaccaaagcctgaaatcatcataaagactgtcagccatacccgtgctgtgtcaggcgtcatattggaaagaagcagcatgccgataaagaaagctataacagatatcagcatcaaattgcggaagcttgccttcgtttggaagattccgccgatcatgcttccgatgactgatccaatcatcatcggcgtcagaatgaagcccgcgcttgtcgccgagctgccgtagaccgcctgaacgaaaatcggaataaataccgctaaaataataaatgttccgccatacaggaaagcgagaatctgtgctgtggcaaacaagcggttcttaaacatccagaaagaaataatcggttcttctgcttttctctccacaataaaaaaggcaatgaagaaaacggcgaatacaataaacagcccgatgatctgaatggaattccaatcgtatgttttgccgccaagctcaagggcgaacatcaggcatacaatggatacgactaaggtaatcgcgccgccccagtctattttctgctttctgtgctccagagattctttgtagtagcgaataatgaaaaacaatgacaatgcgccgatcggcacattgatgtaaaacacccagtgccagctgatcgaatctgtaatgatcgcgcctaagagcggaccaagaacactggataatccaaatacagcaccgaacatgccggacatttttccgcgtttttccggcggaaacaaatcaaagataatggtaaaggcaatcggcaggagcgcgccgcctccgatcccttgaatggcccggaagatgatcagctgattcatcgtctgggcaatcccgcataaagcagaaccgattaagaaaaaaataagtccaaacaggaaaaaacgttttcggccgtacatatcggaaagcttgccgtaaatcggcatgccagccatgaccgccaccatataggatgccgtcacccaggcaaatttatcgaagcttccaagatcggctacgatattgcccatcgcggtggcaacaatcgtattgtccattgcagacatcaagatgcccagcaggagaccgaggaccacaaatttggtggaagcctgttttgctgttgttgtgtccatttgttctacctcctcttacttttctatgtaagttctgatatcatgataatagtttgattgttgaatatctcgattatcaagataaactcgattttatagggaggactgtcagttgtcaacaagaaattccagaagtgagttggaaaagactgctgttcagctttttcgaaaactgggcacaagaacggttctgtttcatcaggcagccgctcaagctctcggtctgtttcccaccgatttgaaatcagctgacatcttaaatgaagcaggtccgatgacggccggagagctggggaaaaaaaccggcctcagcacgggttccgtcacggcgcttgttgaccggctggaaaaagcggggtatgtggctcgtgaaaaggacccgaacgatcgcaggagagtcgtaatcgtccctttgactgcttcgaaaaaacatataaaggatttgttccgtcctctgtctgagtcaacgatggatttgtgccgcgaatatacggaggaggagctggaactcattttcagttttgtaggcaaagccgccgatattatggaggaagagcttgaacgtctgaaacagtaagtgaatttgtgcatagcttggcccgttcccgaataaattgtacaagttacataagagaagggagtacgggccggtgaacatttttttgagctatattgtgctgggactgtccttgtctgcgcctgtggggccagtgaatgcggcgcaaatagacaaaggaattaaaaacggtttttggcatgcatggattttcggtttaggcgccatgacagcggatgggctgtacatgctttttatctatttcgggctgtcgcagttcttgaccgctccatttgtgaaaacgtttttgtggctgttcggcttttttgtcctgacctataccggaattgaaacgctgaaaaacgtcagagaaccgatggatgtgcgaagctcgcgggggaaaccgtcatacaggaaaacattcgcatcgggttttctcatttcattgtcaaacccattgagcatccttttttggcttggaatttacggaagcattcttgcgaaaacagcagaggcctacaatatgaatcagcttctaatctatagctccggcatcatgatcggcattttaatctgggatttctgcatggctatcacagccagtacgttcagaaacctgcttcatgaaaagctattgagaggattgaccggaatcgccggtgtatccctcctcgtgtttggcttttactttggttatcagggcatcaaacagttattgggctgattcttgaaggacagtcacctgccgcttccagttttaatatagtatccagatgatactggaggtggatcaatggtgaatgggatttacaccaaaagttttctggaacgtattcaggaagagcttcctgaatggcaaagaatcgcttttgagctgctggcagaaactctggcggacgatgcggatacgtttccgtgcattcccggacgccaggcgtttctgactgatcagcttcggattgcttttgccggagatccgcgggaaaaccgtacagcggaggaactggctccgttgcttgcggagtacggcaagatatcgcgggacacgggaaaatacgcatccctcgttgtgttgtttgatacaccggaagatttggcggagcattattcgattgaagcgtatgaagagctgttttggcgctttttaaatagactgagtcatcaagacgaaaaagaatggccggaagatattccggccgatcccgagcattataaatgggagttttgttttgacggcgagccgtatttcattctgtgcgctacaccggggcacgaggcaagaagaagccggagctttcctttttttatgatcacgtttcagccaaggtgggtgtttgatgacctaaatggatctactgcatttggccgtaacatgagcaggctgatccgatctcgtttagaggcctatgatcaggctccgattcacccgcaattaggctggtacggaggaaaggataatcgtgaatggaagcagtatttcctccgtgatgacgaaaaacaggtatcgaagtgcccgttttcttatttaaagaacatgttcaacaaaatgaaataaatcaaggactggcagggcgatctttatgaccctgctttttttgatagatcatggtaacgatggcgatgatcacgagaaaacctatgctgacgaaaaaaccgggccggcttgatttttcaaataatgtaccggacacagctacagcaatcagaaccatcgctaaataaatttgcgtttttcccatgccctcgggatcagtcagctttttgctggagaacaggataaacagccaagtgtataaaagcataagccccgcagctgttgtcatatgctcataaatgtttttaggcagcactaacgacagaataatggagaggacaagccccgcaaacgtcagcccaagtgccggccagcatatttttttgccttcctttagagtaaagcatttcggcgcgtcgccgtcatcagccattgtacaaagcaatgtcgtaacggcaaaaagcgaagcgacaagggtcgagaacccggcgatgatgaaaatcccgttaaatatatcaaggatgatctcaaggttatatccttttaatgatgtaatgaacggactgtcctgttcagtaaacgcgtgtaacggaaccaaaagcagagcaagcccgattgaaatgatataaataatcgccagcgtcgccagcatcagtttccctgatttagacgcttcctcaggtttttttaagtgaaccgccatcagccccatgacctcaattccgccaaaagcgtaaaacgcgtagattaaacctgtccatagccccatggcgccgtatgggaaaaactcactcgtcttatttggaacatgtatgccatggtttccgccggacaggataccgcataaagccaggatggcaatgacaataaacataaaaatagcagctgttttaatgactgccagcacgttttctgttttttcaaagacggacaggccggtgaaaataataaggagccccagtactgcgtagattgaggcaaacacccatagcggcacttgaggaaaccaatgcttcgtaaatagcgaaatggctgtcagctggcttccggtaatcagcatttctgatgaccagtacacccagccgttgctgaagcctgcccatttgccgaatgcttttcgggcatacgcacaaaacgatcctttttccggttgcttcgccgaaagcttggcgagctgttcaaagacaaaatacgtaccgatccctgcgatcagaaatgaaaggagaacggaaaaaccgctttttacaattgcgatgctggaaccgagaaagaagcctgttccaatcgtgcagccgactccgatcagtgacagctgccaccaagccagattcccttttggctggtctttttttgtttggctcattatttattcaaccccttttatctaaggttagattgtgatctgtccgaagcttatatacatcggatttttgcctctttttacatggagaaggaagcggacgctcatactaatgaaaaaaggagcaaaccaatgacacagcaatatattgtggagccgaaaaaagggcttgggctgaagctgaaaaaggggcagattttaaaggtggttgatgtagaagggcagcaggtggctgattttgtcgcataccatgccaaggatttttatgaacaccttgatcagggagcgacgatagacgccaatcactccattcatgtgaaggtcaacgaccatctctactccaacctgtataagccgatgctaaccctgattgaagatacggtcggcaagcatgatctgctgctgcccgcctgccgtcctgatatgaacaggctcttatatgggaagcaaaaggatgagtttcaggatacgtgctatgacaatatgaaccgtgcgcttgagcagtttggcgtaccgaagcctcacatgcattatccatttgcgatttttatgaatactgtccttgatgagaaagggaatctgtctgtggaaacgccgctttcgaatgccggagattatgtaaggctcagggcggagatggatttaattgtcgcgttttcttcctgcccgattgaaaaagggaaatgcaatggcgacagtgtgacatccatacgggttgaagtcagctgatctctcttgttcactgtgaatgaagacctgtgctatatttaatagggatacataacagtcatgattcattttcattgatttggggaaatgatcagtaacaagggaaaatgtacaggaggaatgattgggatgagcatgcaggaaaagattatgcgtgagttacatgtgaagccctcaattgatccaaagcaagaaattgaggaccgagtcaattttttaaaacaatatgtaaagaaaaccggtgctaaaggctttgtattgggaatcagcgggggccaggattcaacacttgcgggaagactcgctcagcttgcggtggagagcattcgcgaagagggcggagacgctcaatttatcgcggtccgtcttccgcatggcacacagcaggatgaagacgatgcccagcttgctttgaagtttattaagccggataaatcatggaagtttgatattaaatcgacagtcagcgctttttctgatcagtatcagcaggaaacaggcgatcagctgactgactttaataaaggaaacgtaaaagcaagaacaagaatgatcgcgcaatacgcgatcggcggccaggaaggcctgcttgtgttaggaacagaccatgctgctgaagcagtgactggtttctttacgaagtacggtgacggcggagcagacctcctgccgctgacaggattgacgaagcgccagggaagaaccctgctgaaagagctgggtgcaccggaacgcttatacttaaaagaaccgactgccgatttgctcgacgaaaaaccgcagcagtcggatgaaacagagcttggcatttcctacgacgagattgacgattacctcgaaggaaaagaagtatcagcgaaagtatcagaagcgctggaaaaacgctacagcatgactgaacataaacgccaggttccggcgtctatgtttgatgactggtggaaataagttgaagaaagcccgctctcggagcgggcttttgtcgtgtacagaagctttatttgatgcggatatgattcagctttaccattaatctgtcggtgaaccttcggaggctgcctctcgtatcaggatctaatggaagttcggctctcgcggcaatgttctctgccacatcctgaatcgacaggttgtctgtttgaatgtggtcctcaaaaataggtgatgataagccttcaacgcagcggtcaatttgtttggcggcccaggagttttttccttctgctctggtgcgcagtctttttaacaaggtttcctttgaagccattaatgtaaagtggtgaacgatcctcccttcatgtctgagcctgccgatgatctcattgaagtattcaggatgtacaatcgtcatgggcacaataatgatgccgcggtatgtatctgtcagagaagctagcaaactgtaattgaacgcccgccataaaggatagctttgaaaatcgtcctttgcgatctcctgcggcaccatggagcgcagcgcaaaacccattttctcgggatcatacacgtaagatggtttcagccttctgtgcagttcgaaagctgtttgtgtttttccggaaccgaatgccccgtttatccaaatgatcatcgccatttctcccttcctatttatcatacagaaaaagacccttccatcgaagagtcagctggaaaaacaataaaggcagaaggttttaatgcttttttgcgtcgaagtattaaaatacctgcagaaatgttgtacaatgaatgtcattcaggcaaaaatggctaaacaacaaagcgcactataagcttgaccggtaaagccggtatctatataaatattcgctaaataagcatataatgaatatataatttcattccttaggaggatttcgccgaagatgaacgctaaacgagccatcccagtaagagaaagaaatatcgtcctgatcggattcatgggtgtaggaaaaacaacaatcggccaattggtcgctaaaaaattatatagagattttattgatattgaccaagagatcgaaaaggatttcaatatgacaattcctgagatatttgagaaaaagggagaagactttttccggaaaacggagaaggaatatattttagacatctgccatcataaacgattcaaaatcgtatctctgggcgggggctcttttaaacaagaagaaatcagaaattgctgtctggaaaactgtctcgtgcttcatctggacctgtcatgggagaactggaagcagcgcgcggatttattgatcgaaagccgccctgtactgcataaccgttcaatggatgaaatggaacagctgtttaacgaaagaaaagtcatttatgacaagcacaattcaaaagtggcaacagacaacctttccccggaagaggttgccgattacattgttgagacattaaaaattggctgggatctttatcagccgatgtaaaaagccgtgcgcagcgcacggctttttttatcgttttatcccttgtatcaaaatcgcttttaaacaaaaggagatgggctgtccgttttggttcaatgtaatacagaacgtgtcgcgtgcttcgtctgatgcgtggttcaagtgggcaatgatttgtttttctcggtcagcgggggttccgcctcgtttgatccagctatcgtattgaatcggcaaattccacttttggatgtcttgataggccagttgattggcgctgaacatcgcctgccattctgataatgagctttctcgaacatgggaagggtctcgaagccggttcaaatgattgacaaactcatcaagaatgggatcttcaggcgcgtaatgatcaactaagagaaaacgtccgtcctgtttcagtacgcgtgcaatctcgctgacagctttgcggacatctgaaaaatggtgggctgcgtatcggcaggtgatgatgtcaaatgaatcgtcggggaaggggagtgactctgccgttccttgctgaaagcgtacgttttcagctcctttttcttgcgcgaaggaggacgcaacctcaaccatctctttcgtcgcatcaacaccgatgcactcctgtacataaggagaaaatgccagggccgtatggccggcgcccgctcctatatccagcactcgatgctctgcccggcattccgctgttttgatcatcaaccccaaatcttccccctcggcaaataccttttcatcccgatacatctcggcgtttttagaaaacggtgtttcattagtcatttgaaccagctccttcttttcgtaaatgatgatatggattatgttagcaatttctgttatgattcgtccaagatataaaaatgatgaaaatgataggttcaacctatggaggctgaaatggatattaaagtgatggaatatgcagcggaaattgcccggcgccaaagctttacaaaggcggcggaacatcttcatatcgcacagccgtctctcagccagcaaatcaaaaagcttgaggctgagctggggcttaccctttttcacagatcccatagctctgttacactgacacctcacggcaggcgtttcattgaaaaagccgaggacatcattcgttccagagatgatttgcttcgggaaatgcaggagcgatcacagggaatcggtcataaattatccatcgggattcctgctgtaacagggagatatctctttccccgctgctgaagcagtttttggcgcgctatcctcatgtggaggttcagcttgttgaaaaagatccggtttcattagaggagatgacggcaaagggagaagttgacctttctgttttatccttgcccatcgaggatgaacggctctccattacacccttgctcacggaaccggttgttctcgcggtgccgaaggaaaaacaaaggtggatgccgccggaattggtcgcgctgattgagaaagcgctggaagaagatgagggacgccagccgtgtgtgccgatagacatggtaaggaacgtgccctttattctgttaaaagaaggcttcggctttcgcaggacagttctcgatctctgtgcggaaagcggctttaagccgaatgctgcctttaagacgagccatattgaaaccgcccaatctcttgtggctaacggattaggtgtgacaatggcaccgaatatggtcagaagggataaagatccgggtgtgatctatttatcgattcaatccgcgccatcacgaaccctcgtctttgtctttttaaagaaccgctatgtcagtctgaccgcccaggcctttatggaactaagccgggaaagtcttaaacaaacgtttgatgaatgctgtctgggaaacaaagatgaaaatatttagaaaacaaagccgaaacgtggtagtataggaatacaaactaaatcttataaaacaaaggggaataatcggaaatgcaactattcgatctgccgctcgaccaattgcaaacatataagcctgaaaaaacagcaccgaaagatttttctgagttttggaaattgtctttggaggaacttgcaaaagtccaagcagaacctgatttacagccggttgactatcctgctgacggagtaaaagtgtaccgtctcacatataaaagcttcgaaaacgcccggattaccggatggtacgcggtgcctgacaagcaaggcccgcatccggcgatcgtgaaatatcatggctacaatgcaagctatgatggtgagattcatgaaatggtaaactgggcactccatggctacgccacattcggcatgcttgtccgcggccagcagagcagcgaggatacgagtatttcaccgcacggtcacgctttgggctggatgacgaaaggaattcttgataaagatacatactattaccgcggtgtttatttggacgccgtccgcgcgcttgaggtcatcagcagcttcgacgaggttgacgaaacaaggatcggtgtgacaggaggaagccaaggcggaggtttaaccattgccgcagcggcgctgtcagacattccaaaagccgcggttgccgattatccttatttaagcaacttcgaacgggccattgatgtggcgcttgaacagccgtaccttgaaatcaattccttcttcagaagaaatggcagcccggaaacagaagtgcaggcgatgaagacactttcatatttcgatattatgaatctcgctgaccgagtgaaggtgcctgtcctgatgtcaatcggcctgattgacaaggtcacgccgccgtccaccgtgtttgccgcctacaatcatttggaaacagagaaagagctgaaggtgtaccgctacttcggacatgagtatatccctgcttttcaaacggaaaaacttgctttctttaagcagcatcttaaaggctgataaatgtgaaaagccgccgcatatcatcaggcggtttttttctgcaaactgccggaatgagaacagactggagacgaatagatatgaagcaaagaatcattgatgaattaaaacggatcgagcagtcatacggagtcaaaatcgtgtatgccgtcgagtcaggaagccgcgcatggggatttccctcgcaggatagtgattacgacgtccgctttatttatgtgccgaaaaaggagtggtatttttcaattgagcaggagcgtgatgtcattgaggaaccgattcacgatttgctggatatcagcggctgggagctgagaaaaacgcttcggcttttcaaaaagtcaaaccctccgctcctcgaatggctgtcctcagacattgtgtattacgaagcatttacgaccgcagagcagttaagaaaactgcgcacggaggcatttaagcctgaagcaagcgtgtatcactatatcaatatggcgagaaggaacgtcaaggattatctacaaggacaagaggtcaaaattaaaaagtacttctacgttcttcggcctattttggcctgccaatggattgaaaagcacggaaccataccgccaatggactttactgttttgatgaatgaacttgttgctgaacccgagctgaaggctgaaatggaaaccttgcttgaacggaaaagaagaggagaagagcttgacctcgaagcaagaatcaatgttattcaccaattcattgaaacggaaatcgaaagaatcatggaagcggcaaaagaactgaaggcagagaaaaaagatatgacacctgaattgaaccgtttgcttttgaatacggttgaagaagtgtggaaggatggaggaagctgatgttttttgtcgcttccttttctcctttattcgacagaatccccccgactttctaactatctgattgtggcaaacccacaaaaataatcagaatctttgtattttgagaatattgtgaacgtcggttttgtccatttacaataaactcatacaaatacttcttagattgcggggtgttgaggttggaagtgatcacaagagattttttcttatttttatccaaaagcggctttctcaataaaatggcgaggaactggggaagccgggtagcagcgggtaaaattatcggcgggaatgactttaacagttcaatcccgaccattcgacagcttaacagccaaggtttgtcagttactgtcgatcatttaggcgagtttgtgaacagcgccgaggtcgcacgggagcgtacggaagagtgcattcaaaccattgcgaccatcgcggatcaggagctgaactcacacgtttctttaaaaatgacgtctttaggtttggatatagatatggatttggtgtatgaaaatatgacaaaaatccttcagacggccgagaaacataaaatcatggtcaccattgacatggaggacgaagtcagatgccagaaaacgcttgatattttcaaagatttcagaaagaaatacgagcatgtgagcacagtgctgcaagcctatctgtaccggacggaaaaagacattgacgatttggattctttaaacccgttccttcgccttgtaaaaggagcttataaagaatcagaaaaagtagctttcccggagaaaagcgatgtcgatgaaaattacaaaaaaatcatccgaaagcagctcttaaacggtcactatacagcgattgccacacatgacgacaaaatgatcgactttacaaagcagcttgccaaggaacatggcattgccaatgacaagtttgaatttcagatgctgtacggcatgcggtcgcaaacccagctcagcctcgtaaaagaaggttataacatgagagtctacctgccatacggcgaggattggtacggctattttatgagacgccttgcagaacgtccgtcaaacattgcatttgctttcaaaggaatgacaaagaagtaaaaaaggagagattatcatgacaacaccttacaagcacgagccattcacaaatttccaagatcaaaacaacgtggaagcgtttaaaaaagcgcttgcgacagtaagcgaatatttaggaaaagactatccgcttgtcattaacggcgagagagtggaaacggaagcgaaaatcgtttcaatcaacccggctgataaagaagaagtcgtcggccgagtgtcaaaagcgtctcaagagcacgctgagcaagcgattcaagcggctgcaaaagcatttgaagagtggagatatacgtctcctgaagagagagcggctgtcctgttccgcgctgctgccaaagtccgcagaagaaaacatgaattctcagctttgcttgtgaaagaagcaggaaagccttggaacgaggcggatgccgatacggctgaagcgattgacttcatggagtattatgcacgccaaatgatcgaactggcaaaaggcaaaccggtcaacagccgtgaaggcgagaaaaaccaatatgtatacacgccgactggagtgacagtcgttatcccgccttggaacttcttgtttgcgatcatggcaggcacaacagtggcgccgatcgttactggaaacacagtggttctgaaacctgcgagtgctacacctgttattgcagcaaaatttgttgaggtgcttgaagagtccggattgccaaaaggcgtagtcaactttgttccgggaagcggagcggaagtaggcgactatcttgttgaccatccgaaaacaagccttatcacatttacgggatcaagagaagttggtacgagaattttcgaacgcgcggcgaaggttcagcagggccagcagcatttaaagcgtgtcatcgctgaaatgggcggtaaagatacggttgttgttgatgaggatgcggacattgaattagcggctcaatcgatctttacttcagcattcggctttgcgggacaaaaatgctctgcaggttcacgtgcagttgttcatgaaaaagtgtatgatcaagtattagagcgtgtcattgaaattacggaatcaaaagtaacagctaaacctgacagtgcagatgtttatatgggacctgtcattgaccaaggttcttatgataaaattatgagctatattgagattggaaaacaggaagggcgtttagtaagcggcggtactggtgatgattcgaaaggatacttcatcaaaccgacgatcttcgctgaccttgatccgaaagcaagactcatgcaggaagaaattttcggacctgtcgttgcattttgtaaagtgtcagactttgatgaagctttagaagtggcaaacaatactgaatatggtttgacaggcgcggttatcacaaacaaccgcaagcacatcgagcgtgcgaaacaggaattccatgtcggaaacctatacttcaaccgcaactgtacaggtgctatcgtcggctaccatccgtttggcggcttcaaaatgtcgggaacggattcaaaagcaggcgggccggattacttggctctgcatatgcaagcaaaaacaatcagtgaaatgttctaagcgggactaaatgggcatcctccctgcgggggtgtccatttcatccatatactataaaaaagaggaggaagtgccatagaaaacacacagctgattatttcgatttgtatttatatggcgggaatgctgctaatcggctactttgcttacaagcgtacgtcgaatctgacggattacatgctgggaggacgctctttgggtccggcagtaaccgctctcagtgccggcgctgccgatatgagcggctggctgctgatggggcttccgggtgccatgttttctactggtctgagcggagtttggattgtgttcggactttgtcttggagcgtgggcgaactggctttacgtcgcaccgcggctgagaacctatactgaaaaagcggggaattccattacaattcccggattcctggaaaatcgtttcggagatcaaacaaagcttctcagactgttttcgggaattgtcattttagtctttttcacgttttatgtatcgtccggcatggtgtccggcggcgttttattcaacagcatcttggggatggattatcacaccggcctgtggattgtgacaggtgttgttgtggcatataccctgtttggcggctttttggcagtcagctggacagattttgttcaggggatcattatgtttgccgcactcattcttgtgccgatcgttacgtttttccacacgggaggagcaggtgatacagttgctgaaatccgctctgtagatcctgatatgtttaatattttcaaaggaacgagcgtccttggcattatttctttgtttgcctgggggctgggatactttggccagccgcatattattgtgcgttttatggcgatcacgtctgtcaaagagatcaaaagagcgcgcagaatcgggatgggctggatgattttgtctgcagtaggcgcagtgctgaccggtttgggcggaatcgcttattaccatcagcggggcatgacactgaaggaccctgagacgatttttattcagttagggaatatcttgttccatccgattatcacgggttttctgatttcagcgattttggccgcgattatgagtacaatttcttcccagctgcttgtaacatcaagctctctggtagaagatttgtataagtcgatgttcagacgctcagcttcagataaagaactggtgtttttaggccgtctggctgttctggctgtttcaattgtcgcgttggttctggcttgggagaaaaataacaccatccttggattggtcagctacgcgtgggcgggcttcggtgcatcattcgggccggttgtactgctcagtctgttttggaaacgaatgaccaaatggggggcactcgccggcatgattgtgggagcagcgactgtaatcatttgggcgaatgccggtctttcggactttctgtatgaaatgatacctggttttgctgcgagtctattatctgtgttttttgtcagcatattgacgcaggctccgtcacaagctgtcacagaccagttcaacgactaccaagatacaatgtcacaataaagatcgaaaggaggaggaaggggctgtccctttttcctcttttctccttttaagcggccatttttttcttttggaaacaaacgtatttttttctatacaaaaagaccccgtatggatatgattaaagtaaaaaaagtataggagaaaaaggtatggaagagcttttagagagagttttttcattttcagatgttgataaactgattgattttattagctatgagctgcaaaagccagtgatactggaaagcgcggatttctttttgttagcctataattcttactatattaaccattttgattctgccaaccagcagactattttttcgaaaaagtgtccggtccagatttttgagaggtttctgaaggacggaattattgaaaaattgaaaacagagcctgagccttttcgcgtcaataaaattgaaagcattgggttaaaccagagggtggtcgtgagtgcaaagcacaaaggggaagtcatgggctacatctggattcaggagctggaccaaaatctgacggatgaagagctcgactttttgtacgagacctccttccatgtcgggaaaatcatttataaaacgaataaattgaaacaggaaaaggaagaaaaagcagaggatctcatcaaacgggcgatctatcagcaatttacctctgagaaggaactcagacgggaagctgaaaggatcaacaccgtgctgccttccatgttttcagttgttatcctgcacgccgcaaatggggatggggaagcggtagaggatttaaaggaaaatatcaggtcgtacctgaatttacgggataaggtcagtcatgtcttaacgatcgaatcaaatattgtcatcgtcgtagcgagtttttcccaaaaaagctccgtctcctcagcagcttctgagtttattaacaagctgttaacacattttcactttcaaaaaatacctacccctatttatatcggtatcggaaacgaatataatcacctattaaaacttggcaagagctacacagaagcacttgaagtcatcaaagccgcagaaatcaccggcaatcaggaaaacattccatatgaatatgccaaactcggcatttaccgctatttagaaagcatcgaacagaaaaatgaatttttagaatacgagaataaagatttagctttattaaaagcgaaagacgaagaaagcagcactgagctgctcaaaaccttggaaatctatctcctcaacaactgcaaaacaaaaccagcggcagaacagctgtttattcaccaaaatacattgaattaccgcatcaaacagattactgagatgacgtcgatcgatttaagcgatttcagaacgcggtgccagctctatctcgatttgatgctgatgaaaaagaaataaaaaagaaaccagtacttgtactggtttcgtcttcacttaaaatcctctgtaaacatacggatcatcaggttttttaatggtattccagtcagttactttgacgacagggagagttgacttgaatggctggtaatattctgaggccagagtgcccttaatgtgaatccattcatcatccttgatgtccatgtccttcggaaattccacaagcatcccgtacacgccggaatcagcgatacagtgaatgatgccaaaccttaatacgaacagctgatttttgttaattgcgtttcctttgtaagcaaatccatggaattctatcgtccgtccgagaaattcacccggatagttatagatggtttccattccttttaggaaatcgtcatcggtcagagaaatctcttttttgctggaatacttattaaacagctgtttcatttgtttgtcatagctgtcttgcgcgtaatacaagctggcatcaggccgcaaatactgtgtttgggagtagtgatctccgctctccatcgccttaaacgagaacccttttgttttgacaatggatgagtcaagcgttgcaatcgggaagaagatgcctgacaccaaaggaaaaagaaaaacaacataaatcaaataacgctgataaaatggcttgttttgttcatggtcatgctcgtgatcatggccgcacccgcaatcatggtcatggtgatgcccgcttttttcaggcgacttgataaatagatacgcttggacggcggtcagaatagccagcaggaagatcgcaataaaggacagataggaatatttcatattgatatattttgttagatttcctgaggcatgcagatgataaaagaaaaacgtaaatcccatcagcaccaatagacgaaacacccaatcacccctttaccagtagtgatcccgctaaaacaatcacgacaatgtatgtaatcagcaggaaaacaaatcgttttttgaaggccgcaagcatcatcaatagattcttaatatccaccattgcgccaaagacgagaaaggcgattaacgatcctaatgaaaatgtgctgctgaaggaagacgcgatgaacgcatcaacttctgaacaaagcgacaggacaaacgccagacccatcatcacgagggaagaggatacatcattctgcccgatcgcaagcagagtggatgttttgacatacgtctgcatagcggctgcgataaaggcgccgatgattaaatattttcccacggagaaaaattcatcaatggcatgccgcaaggtcccgcccagtttttggagcaaggtgccgtgatgatgatggtggtgcccgggttcatcaggctttaaaagctggttatccttaaattgataggataagatgaccccgatgatcagcgaaacggcgagagccagtccgcctctgtaaaagacaacgctccatctattcccgaacgcaatataagtagaaaataaaacgataggattaatgataggcgcggtcagcatgaaagcaacgcccgcatgcagaggaactccctttaacagaagccgcctcgtaatcgggatgatgccgcattcgcaggcgggaaataaaacgccggccagcgcaccgaataaaacggcgagaaaacggtttttcggcatgattcttgcaatcatttcttcagaaacaaacatttgaatgattccggaaagtatgacgccaatcagaataaacggaatggcttctattaaaatgctgataaaaatagaattcagctgaagaaaagatgattgtgctgtcacaataaaacctccgctcatgttaagctgcctttcttatgataccagaaaaaaaggcactgcttgtttgacggaggaggggaaaggatcgtttcactttggttaggattccaaaaagccgagtaagatactgtctgtttctgcagcttcttttccgagccaaatcaggtgtccccatgagtgaagcaaacagagagcagcgccacgaatgtgctcttttgcatgatgtgcatgtgacaagtcaaccaatccatcataaacactttgcataatcagcacgggagatatgatggcttgcaggtcttttaaagagacagcggcggtttgtgacaagtcaatcagaaatccttcacccgagcgctgccggctgttcattttccgaaatgcttctatgtctttttcatccattaaggacttgattcgctgaaacggaatcgtgctgaattgggggctcatagctcgaaacatcaaacgcgggaaagcgttattcaaagaagaaatcagcttccatatccacttttccaccggcgggcggaagagaattctccccaatttatattcagtgtcttttggggtgagccactctttggtgaccgcggattgcagggtcaatgtatttactctttctggataatgtgaggcaaagcatatgccgctcggccctcctgctgagatggcgatcacatggacactgtcgatttgtaaatgatctaataatttcacatagaaacggcaggcgttggcaagactttttccaatttcttttgacgttcgtccatagccgggtcttgaaggcgtaatgatggaatacccttgttcaatcaacgctgtgtatccgaattcctcgtaacaatttgaatgcccgccatgcatgacaaggatcggagttcccttgcctgtcacagaatattctagtgtactgccatcgaaggtgatcgtttcgactcgtcttttcatctgtttcacccaattggtttttgcctattatagagttttcagcaattgaccacaaggtagaagaaatgaataaacaaaggcccttgaaatatgatatactttgtattgatattcattctcaattaaaactttgatatagatgtgaacgggaggcaggacggatggctgagaatcaagaggtatatgacgttacgattataggcggggggccgattgggctgtttactgctttttactgcgggatgcgggagctaaaaacaaaggtaatcgaatttttgccgaagctcggagggaaggtgtctttattctttcctgagaaaatcattcgcgatatcggcggcataccggggattgcgggaaagcagctgatcgagcagctgaaggagcaggcggcaacgtttgatcctgatatcgtattgaatcagcgtgtgaccgggtttgaacgcctagatgaaggcaccattgttctgacgggttctgaaggggaaaagcactatacaagaactgtgattttggcttgcggcatgggtacacttgaggtcaatgagtttgacagcgaggatgcggcccgatatgcgggcaaaaatcttcattatggagtggagaagctcgatgcgtttaaagataagcgcgtggtgatatcaggcggcggagatactgcggttgattgggctaatgagcttgaaccgattgcggcgtctgtgactgtcgttcatcgccgcgaggaattcggaggaatggaaagcagcgtgacgaaaatgaaacaatcatcggtgcgggtgcttactccttattgtctagagcagctgagcggcgatgaagagcgcatcaaaagcgtgacgatttgtcatgctgaatcaggccaaagggaagatatagaggttgatgagctgatcattaatcatggcttcaaaattgatctagggccgatgatggagtgggggctggagattgaagaaggaagggtgaaagctgacagacatatgcgaacgaatcttccgggcgtgtttgtggcgggcgatgcggctttttatgaaagcaagctgagattaattgccggcggctttaccgaaggcccgacagcagtcaacagcgcaaaggcttatttggatcctaaggctgagaatatggcgatgtattcaacccatcataaaaaattggtacataaataaaacagcccttggggaaagggctgtttgccatcagctgtgaaggagttttctttccgcttgttgattttggatgaaagcaaataattcatcctgttcttggatggctgtgaatccataagccccggcagctgagtcatcgcctatacagacgatagggggccggcttgctgacggttccggcgaaatgccaatttgttcgccaccattgatcaattgctgaacggacagcttgttcgggcaaatgaccatgtgcagctgggattcactgatggtacgctgaatcatgtgggtgaaccggtcatctatgacgttttcatgagtgatataaaacgaacaggattcttgcttttgcatgaattccactgcatggcggctcccgacaacaagacgtttttctgaatcaggctgaatggcggtgacaagaaagccccgtttttcaagctccgtctttgcttgctcagatgctgcactcagtttggctgtcagctggcggatgtcgattttctgagaagccagtgctctgaaaaattcacaaaccgcccggcgcgatgtgaaaaaaacgtcttcaaaggtgccaatctttcgaagaatttcttcattgacaggcatgttttcggtccgccatttcggccactcgatgagatcggcgccggaatcgcgcagcttgtctgcaagcgggtcttcatcttcgccatgagtcacaaccatcaaatgccgtccgatgagcggtttgctttcaaaccagctgtgtgtttgaaagttgacgatgtctccgatgacgataatcgcagggtttgtaatctggtgttcctgcactttttgctgaatgttctcaagtgttcctttcacactccgctggcggccccacgttccccattggatgacaatgacagggacagaaggcgatttcccgtatgaaataagctgctggcaaatataagacaagttcttgacacccatgtaaaaaacaagggtttgtacgcttcgggctagcccttcccagtcaaggttcggcgtgccttttaatgatttatcatgcgctgtaatcatggcaaaagacgatgcaaaatcccgatgcgtgacggggatgcccgcatatagcggcgctgcaattccagaggtgattcccggcaccatttcatagcgaatgccgtgctcatgaagagcatctgcttcctcgccgactctgccgaatacgctcggatctccgcccttcaagcgaacgacggttaatccatttaatgctttttcaaccagcagggcgttaatttctttttgtttcataaaatggcggtttggcagttttccgcaataaataaactggcagtccggtgatgcaaattcgagcagcttcgggttggcgagccggtcatataaaatcacatctgcttcctcgagcgcctgttttcctttgatggtgagcaggcctgggtcgccgggtccggctcccacgaaatatacgattccgttcttcatgatcatgtcatccttccgtcactgtaaaaaatgaaggaccactagaaaagtgatccggtcttttgatcaatatacgagataaacatgttctccttcgatcagcgtttcatatgttttgacgcatccgtggtcaggttcttggacgattccgtcttctaaggaaattttccagtcatgcatcgggcagaaaacatattgaccgctgacgatgccttctgccaggacgccgcccttatgcggacagcggttttcgatggcgcggatgcttccgtctgaaagcttgaaaaccgcgagctccttatcttcaatatacactgttttgcctaattgttcaggcaattcttcaatttttccgatacatacttttgttacgtctttgtttaccatgtccattcctcctcaatgatttttttgtcattatgatgtggtcacgacattttcaaataattctttagaggtttgtttatcctctaaaaagtctttccacggatccttgtggacagagagtgtttcattcattcggccgttcagctcctgccgcttttccggatcgtttaacacggattggacatgggataaaccgacgcgctcaagccatgcggacgtacgctccagatagtttgcggtttccctgtaatattgcaggtaagcgcctgcgtattctaagacttcttcatttgttttcaccttcatcagcaaatcgccggcacgcaaatgggttccgccgtttccgccgacataaagctcccagcctccgtcaatgccgacaacgccaaggtccttaatgccggattccgcacagtttcgcgggcaggcagacacggccattttgactttgtgaggcgtgttcagcccttcgaattttttctcaagcgcaatgcccagtgccatggagtcttgtgtgccgaagcggcagaattgctcgcctacacatgttttcactgtgcggagcgtttttccgtacgcgtagcccgacggcatatcaagatcttcccataccttcggaaggtcttcttttttcacgccgataagatcaattcgctggccgcctgtcattttcacgagcgggatctcatatttgtcaacgacatcggcgatcttgcgcaagtctgtggagttggtcacgccgccgtacatccgaggaacgactgagtatgttccgtctttttgaatattggcgtgcattcgttcattaacaaagcgggatgtccggtcatcctcgtatttggttggattgatcatgcctaagtagtagttcagagcgggccggcatttagaacagccttctggcgttttccagccgagcacattcatgacttctcttgtatgtgacagccctttggctttgatttcttctacgacttcatctctcgacaatgtggtgcagccgcaaatggcttctttttgcgctgacgcatcaaagtctgatccgagcgtatgctggaggatttcttctacgagcggcttacagcctccgcatgagcgggatgcaccggtgcatgctttgatttcgtccgttgacgagcagcccttttcctgtatggcttgaataatcgcaccttttgacacgccgttgcagccgcagatgatttcatcgtcgctcatcgctgcggttatgcttgtgcctgcttcttggctgagaggctgtaagattgatattttagaggtttcagagatatcggcttctttttgaatcatagaaaacaggcgattgccttcgctgctgtcgccgaataaaacagcaccgacaatttgattgcctctcaggacgatttttttatagatgccgtcctgctcatcgaagactttaatcgcttttttctcctctgattcgttaaagtcaccggcagagaagacctcgacgcctgatacctttaactgtgtggagagaacggagccctcatacggttttgtttcgatgccgcaaatatgctttgccagcacttttgcctgttcatacagcggcgccacaagcccgtaggcgattcctcggtgctcggcacattcgccgaccgcgtaaatgtgcgggatttcagtctgcatataatcgttgacgatgatgccgcggttaaccggaatgccgctctcggccccgagcgttgtatttgggcggatgccgacagccatgacgactaaatcagcttcaatgcttgtgccatccttgaatcggaggccttcgacacggtcgtcaccgacaatttcttctgtttgcttttcaagtaaaaaggtcataccttgtttttctaactcgttttgcagcaggcgtcctgccgttgcatcaagctggcgctccatcaggaatggggcaaggtggatgacggacacatccatgccaagattcagcagtccgcgagctgcttccaaaccaagaagtcctccgccgatgacggcagcttttttatattgttttgacgcggcgagcattgtgtctgtatcttttatgtcccggaaagctgtgacgccttttttgtctgcgcccggaatcggaaggataaaagggaccgagcctgtcgccaggatcaattcatcgtaaggctggattctgtctgcatctgtgatgactgttttgttttccgtgtccactttgatgactgtttcatttgtatacaattgaatgttgttttcttcgtaccagtcccaatcgtttaacgtaatatctttaatatctgtatcgccttgaagcacttttgacaaaaggattcggttgtaattgggatgcggttcggcaccgaaaattgtgatctgaaactcgtctttagcaacactcagtatctcttcaatggcccttaccccggccattccattaccaacaagaactagctgtttttttcccatcagatgatccgctccttatcaatgttttttccagcgtagcacagcaaaaaggaatatttaagatacatgttataaaatgtaacaaaatatacgaaaagttctaaaaattttatgaaaaatttaaataggtctgattcggacggcgcataccttaaaaccgggcattttacaggctggatctaaggcttctccgattaaatcattcacattttgagcgtctgcccaatgaatgggaacaaaaacagtatcttttctgatttgttctgataatttgctgcggacggtgatgcttccccgcggcgattctatttttaccagtacacggtcctcgatattgtaggtcgctgctgtttgcggatggatctccataaacgattcaaaatgtctcgcggcaagggcggcgctttttcttgtttggacgcctgttaagtagtgagacatgactctgcctgtcgttaaataaagcggataatcggctgttggcttctcttttggaacagatggttcgtttggaatcacacttaatgccgctttttgatccggatgagcaaatgattctgtaaacaagcgcccagttccgggatgatcagattccggacacggccaatgaatgccgccttcacgtctgagcctgccgtatgagatgcctgaataatcggcaatcccgcctcggctcgcttctctcaattcattaaaaatatcctccgctgacgtataagagaagtagcgacccttgccgagagcggatgcgagatcacaaatgatctgccaatcatgctttgcttcgccgagacatggccggcttgcttctcttaatgtcacgcgtccttctacatttgtcatggtgccttcatcttctaagtaagaggaggcgggtaaaatcacatctgcgtatttcgcagtctcagaaataaacaaatcgattgcaacaaagaatgtcagtttacgtaaagcctttttcacgagattcgcatttggactggagacagcaggattggagcacatgaggaacaatcctttgatgtcgccgtcattgattttttccatcatttcataggctgagacaccttttcgcggcagatcatcctgatggattccccacacttgcgcaacatgtgcccggtgttgttcgttttcaatagatcgatagcccggaagctgatcggctttttggccatgctctcttgcaccttgcccgttgccttgtccggtgatcgccccgtaacctgagtaaggcttgccgatttttcctgtgatcagcaccatgtttaagaagcctttcacagccgctgttccatcggtttgctgttcaatcccgcgggctgtaaacagcatgccggacgtttccttggcaaactttacagccgcttttcttatatccgccagcgggacactcgtctgttcggcgatgtcattcaggtccaacgagtcagtatgctgcttcagctcttcgaatccatttgttcgtgattgaatgaaatcctcgtttataagctgttcgtcaatgatgattttgacgaggccgttggaaagggcggcgtctgtgccgggtttgattttcagatgaagatcggcgatttttgttgttgctgtttcacgcggatcaatggcaatgatgtaagctccgttttctttcgctttttcaaaatacggcataatcgtaggctggcattccgcgatattggtgccggccagaatgatcacacgggtgtggggaatgtctgataagggattcgttaagcctctgtcggctccgaatgtttggttggctgcggttgctgcggcggacatacaaagcctcccgttatagtcgatgtattttgtctgtaagcccacccgtgcgaatttccctaacaaatacgcctcttcatttgtaatcgaggcgcttccgtataccgccatggcgtcatggccgtgttctgcttggatcattgtcacttggtctttaatgtaattcaatgcttcttcccaggaaacagggataaactcgccgtttttcttcagcagagggcgggtgatgcgagaggagttcaaggcatgctggtgagcattcatgcccttcatgcatagccgaccctgtgtcgtaggattatcaatcccgatcgcagtgtactttttgcgcgtgacgatggtttgttccacgagctgcattttgcactgcatgctgcaaaacgggcattgagtgtcatatgttttttctgattggacgtcttgctgtttatcacggaaatatctaagcagtcgttcagtcaaaatgcctcatcctttcttatatgcgcccgtctctacagtcgggttttgaatcagtgacagatctgtttggaggctttccagcagctgtgcccttaggtcttcttcgaatagcacttctctgatatgaacgatcccgagacggtctatccactgatgaacagcttctaagtaatgagccgtttcccgataatactggatcagtcctttgatcatgccggcagtgctgtcttcgttctcagtcacgcaaaacagagctcctgaacgggcatgagttccccggacgccgccgatgtgaatgtcccagccagcttgtgtccgaattgcgccgacatcttgcagggcggcatcggtgcagtcagtttcacatgataagctgatagaaatgggagcgggtaagggaagcgtctcaagttgtctttcgatttgggctgccagctgctgaatcgatcgattttgcccgcatgtacatgctttgatggtttgcagcgtgtgtcggtgttcattagtgtaaacgggcattttcaggtcttttttcatgttcgggagatccgcaggcttgatcccggaaagcttcagcctttggccgtgagtgatggatacgtcggaaatgctgtatgcctcaatgatgttagcgatggttcttagctgatccgcgtttgtccgccccccgtacatttgcggaatcaggatgcatgtctcttcagtggctggctcaggctgtacaaacccggggtacagcatttccagatagtattgaatcgcaggaacacaagtactgcatcctttttttgttttccagtcaagctggttcatcacttctgccggattagtgaatggcctgcgctgaagctcagcgatgatgtcgtcttctgtaaaatcagtacagccgcaaaacgaaagtgtgccggcgggcttcgtatattcgctgttggtcatgtacctcaaaaggtcttcaacgagcggtttgcatcctccgcaggacccagaggctttggtgcagtgcttgacttcctcaacagttgttaagcttttcgtgttcaccgcatcttcaatcgcgcctttcgtcactgtgttgcattggcaaatcgtttcactggaaggcatggattcaaataaagtgctgcttgtctccggttcgatgatctgctttttgacaatggagatgtctcgttgtttaagcaggctgtcgagaagccgctgcttgtcacgggtgtctccgaataaaataacgccggccagtttgtcatctacaaaaagcgcttttttataaacgcctgcttgttcgtcgtagattttgatgctcgtcgtgcgttcatcctcttggatctttcctgctgaccacacatcgattccagctatttttaacgccgcagatggtgctgagccttgatattcctcacatggaacgccgcaaatatgactggcgagaacttttccctgctcataaagcggagccaccaatccgtacaccgttccgttatgctcagcgcattcaccaacggcgtagatattcggttcgcttgtctgcatgaagtcattcacgatgatcccgcggttcactttgattccagcagatacagccaattcaatattcggtttgacgccggccgccatcacaatcaagtctgcttttaatgaagagccatctttaaaatggattcggtctgctttcgtggtgccggaaatggagacggtgtctttctccaaaagaaaggttaggcctttttgttccagctctgtttgcagcagccgcgccgctgtttgatcgagctgtttttgcataatgccggcggagtggtgaatgacgctgacatccataccgagatgctgtaaaccgactgcagcttccagtcctaataagccggctccgattaccgcagccttttgaaagtgctgggccatcctcatcagcgcttggcagtcttctattgtccgaaatccatagacaccttttttgtctgccccggggatagggagaatatgaggggaggagcctgttgccactattaatttgtcatacgacagagtgcgtttccgatctgtgatgacctgctgctgatctgtatcaatttgaataaccgtttcgcctgtgtaaagcgtgatcccgtgcttgtcgtaccaatccttgctgttcagtgtaatatcatcgagtgacgcttcaccctgcaatacagaggataagagaatgcgattgtaattgggatgcggctcgcttccgaaaatgacaatctcaaacatgtggcgattcagctttaatacttcttcaatacagcggattccggccatgccgtttcccgctaacaccaatctttgtttcttcatgtatcagacctcctttggcgaagctcgtaagttttctcctattaaaaattatgtcacaatgcactgttaacgcattaaacgtgtcacaaaaacttacacatgtcttttccagaaaataatggtcctatatccttgattcagaaaatgtaaaataatgagggtctagaaaggggaatcttatgaagctgtcggaactgaaaactagcggtcatccactcactttgctctgttcctttttatactttgatgtcagttttatgatatgggttatgcttggggcgctaggtgtttatatttctcaggattttggcctgtctccttttgagaaagggcttgtcgtagctgtgccgattttatctggatcagtgtttcgtatcattcttggtattttaacggacagaatcggaccgaaaaaaacggcagtgatcgggatgctggtgacgatgattccgctgctttgggggacattcggcggccgttccctgactgagctgtatgccatcgggattctgcttggcgtggcgggggcaagctttgctgtagcgctgcctatggccagccgatggtatccgcctcatttgcaggggcttgcgatggggattgccggagcggggaacagcggcacgttgtttgcaaccctgtttggccctcgtctggcagagcagttcggctggcacattgtcatgggaattgcgctaattccattattgatcgtctttattctttttgtatccatggcaaaggattctcctgcacagccgtctccccagccgctcaaaagctatctgcatgtgttcgggcaaaaggaaacatggtttttctgcctgctgtacagcgtcacatttggcggatttgtcgggctctcaagctttttatctattttctttgttgatcaataccagctgtcaaaaattcatgcgggggacttcgttacattatgtgtggcggcggggagctttttccggcctgtcgggggcttgatttcggatcgtgtcggcggcacgaaagttctttctgtactgtttgtcatcgtggcactgtgtatggccggagtcagcagcctgccatctctctcaatggttattgttctattgtttgtcggaatgatggggctcggaatgggtaacggtgcagtattccagctcgtgccgcagcgttttcgcaaagaaattggcatggtgacgggaattgtcggtgcggccggaggaatcggtgggtttttcctgccgaacatcttaggatctctcaaacagatgacaggcacatatgctatcggttttatcacgttttcctgtatcgccctgctggcatttgcacttgtgcttgccgcaggctattactggagaaaaagctggagcgcggaaagcagcccggcggatgtttagggttttgacggacacgcgtttgtgcgtgtcttttttattttctcttgattttcaacagtgaaccgatcaaaataaatagtaattattacgatttgttagcgagaggagttttctgaatgaatcaacatacgctgctcccgaaaaaaacggagcgtcttcaatactttggatcggtcagtccgatcaaaggcgagaaaccagtggaaaaagagaaaatgaaggacctgcaaaatatcaggaaggattatttttttgacattcagcatgtaggtgtagctaatgtgtcccatccagtcacaatcacttctgccatgatgcctgccgagcaaacaacggctgcgaactttacaatgacttgtaatttgccgagaaatcagaaggggattaacatgagccggttaacagagctgctgcaagtctatcatcaaaatggctgggttctctcattttcctctcttcagcaatttacgaaagagcttgcagaaaacatggacatatcatctgccacagttgaagtgaggtttccgtggtttttcgaacggaaaagcccgaagcttgagaaagcgggtttgatgcatgctgatatattcatgtctgtcacctatcgcaaagatcagccgtttaaacagcgtgccggcatctcagcaaaagtaacgactctgtgcccttgctccaaggaaatcagcgaatacagtgcccataatcagaggggaacggtcagcatttgggcggatattcacccggccgcatcgctgccaagtgatgttaaagctgatttgcttcacgccgcagaatcaaatgcttctgcgagactgcatccggtattgaagcggcctgatgaaaaagccgtgacagaaacggcctatgaaaacccgagatttgttgaggatctcgtccggctgattgctgctgatttgtttgagcttgaatgggtgtcagcctttgagattgaatgccgaaatgaagaatcgatccatctccacgatgcctatgcgaagctgtgtttttcgaaggaagtggatagaatatgaaactctcattattcattgttgcagttcttatgccagccagcctgctgtcagcctgctccgatcatgcagaagaacacgcaagtatcaatacaaagaaaacggtcgaaaacataacggatgttcgaaaaacagcaaaaacaagcattgattggacgaagccttcgggcggagaatacccggatattaaacagaagcatgtctggattgatgtgaatgtgaaggagcagaaggcttacatcaaggaaggaagcaacactatctatacaatgatgatctcttctggtcttgatcaaacaaaagatgatgctacgccaaagggcaccttttatgtagagcctgaacggggagaatggtttttctccgaaggataccaggaaggcgcagaatactgggtatcatggaaaaaccacggcgaatttctatttcatagtgtgccaatgacaaaggatcaaaaagtcatcaaaacggaagcagaaaaactaggaacgaaagcatctcacggttgtatcaggctgatcattccagatgcaaaatggatatatgaaaatatccctgaacatacaaaagtggtgatcagctgaattgaaaaccgttgacaaaaaggaaaaaagaccatacaatttaaatcgtaacaattacgttttatgataaatggcttatcattgtctgtgcatctgtgaaaagcggaaaggcatcgattaaggatcttgctgtcggcaagggcagggatttgcgatggggaaaaggattaaacgcggttggagcctttactgatttataaatcgggcggcagcgagaaatgagcgcgaaaagctgctctacaccattgtacatatggcaaagtatacaatttaaatcgtaatcattctattttaatggaggcattattatgaaaaaaattccggttaccgtactgagcggttatctcggtgcgggaaaaacaacattgctgaacagcattctgcaaaatcgcgaaggcttgaaaatagcggttatcgtaaacgatatgagcgaggtgaacattgacgcgggcttggttaagcaggaagggggcctttccagaacagatgaaaagcttgtggaaatgtcaaacggctgcatttgctgcacgcttcgcgaagacttattaattgaagttgagaagctggcaaaagacggacggtttgattatatcgtcatcgaatcgacaggaatcagtgaaccgatcccggtggcccagactttctcttatatcgatgaagaaatgggaatcgatcttacaaaattctgtcagctggatacgatggtgacagtggttgatgccaaccgtttttggcatgattatcagtcaggcgaaagccttctggaccgcaaagaagcattggggaagaggatgaaagagaaatcgccgacctcttgatcgatcaaattgagttttgcgatgtactgatcttaaataaatgtgatttggtcagcgagcaagagctcgaacagcttgaaaacgttcttcgtaaactgcagccaagagccaagttcattcgttccgtcaaaggaaatgtaaaaccgcaggagattttgcatacagggttatttaacttcgaggaagcgagcggatcggcgggctggattcaagagctgacggcaggccatgcggaacacaccccggaaacagaagaatacggtatctcttcatttgtatataagagacgtttgccgtttcattctacacggttttatcaatggatagatcaaatgccaaagaacgtggttcgtgccaaaggaatcgtctggtgcgcatctcataacaacctcgctttgctgatgtcgcaagcaggtccgtcggttacgattgagcctgtatcttattgggtggcggcgctgccgaagcttgagcaggagcaagtcaaacagcaggagccggaaatcctggaggagtgggacccggagttcggcgaccgcctaacgcagctagtttttatcggaactgacctggatgaagaaacgatcacgaaagagcttgatcaatgcctgttgactgagtatgaatttgattccgactggtcgctgtttgaggacccgtttaaatggaagctgaatcaatagaaaaaaagccgtcccatggggaacggctttttttaatgaaacgtttgtttaaacataatgagcgtattttttctcaaggatattctgaaagaccgcggcaatggagcagatggcccaataaatgagagcggtcagaatatacatggtcatataatcaaactctctgcccccgatgattttcgcatgctggagcaattccggcactgtaatcatcgcagcgagagatgacgccttgattaagtcgagcaatacattggcaagcggaggcagcgcaatacgtatcgattgcggcaaaatgatgcccctcatcgtctgccaataggaaagacccagcgaggatgcggcttcccactgtcctttttcgacggatgaaatggctgaacggttaatttccgcaatgtaggcggcgctgttaaggctaaagccgattaaagcagccgtgatagcggaaaattgaatgccgatataaggaaacccgaaataaaggataaacaaaatcactaaaatcggaacgccccgcataaatgagatatagagcttcgccggccatcttaacaaagcaatcttagacattctggcgagtgatatgaacaggccgatcacagttcccgcaaacatgcttacaaaagagatgagcagtgtatacccaatgccttttatgacataagggaacgattcaatagccagcttcgtgttgaaaatatattcccattgaatgctattgatcatggcgtccgattacaaatcaacgtcctgaacgtcggcatcaattttttttgatacatctgctttattgaagaattgtttcgacagtttagtcaaagagccatccttgctcatctctttcaatgcttcgttcatctttttctgaagtgcctcattgctttttttcatgacaagggcctgtttgttcggcatgtacttgatgtcaggatgaattgtaatgttgagatccgggaatgccgcgagcgcaagtgtctgcaggtaatagtcgtttaaaatgacgtcagtgcgtccgttggcaacatcttttaaatattgctcattcgtcgcattatcataaatcacttctttggcgccgtattttctcgcgacatccatgtagacggtcgtagccgcgccagccgctttcttcccttttaaatccttaagcgttttaatcccggataaatcgtctttacggacaattgccgtaccgtatgaatatttatatggagtagaaaatgcgaacttcttctcgcggtccttcgtcacatcgatgtcattcgcggctgcgtcaacctgtccgctgttcaccgctgtcagcatcccgtcaatgcccatctccttgaactcaaccttcagtcccaggcgttttgccgcttcacgaacgacttcaacctcgtagcccgtcagcttatcggagccagagtcggtatcatgataagaagtgggataaagcgtacctgatgtagcgactacgattttccctttgtccttgatttgctcccagcctgtatccttggaatcggcttcatttttgccggaacaggctgccaatataagaaagaaagccattgtgaaactgaatataacggctttggattgcttgaatgatttcacctatatttcccccaatctgttaatcaactaaaaagatagcattgaacataaggggttgcaatatgttgatcgcgttttcaaaaagttcgaattgtgtatacaaaaagcataggtgggtgtttaaaagcgtctatgaagggaagaggtgatgaaaaaaggagttgtccaaggatgaatgccagacgtaccaaggaaacacatgtggacgtgatggatgcagaagatcagttattcctctatgccaataccgtaagaaatggtcaagaagcatgaaatcgatcttcagaataaatttaagtcttgctgatgcccctaagacatatgatatatccgatgagaaagaaaatggaaacatttaaaccataatggggagtcaaatgaatatttacaaaccagccggattttggatcagacttggagctgcattgttagactatattatagtctccgtgccgcttttgctgatctattggctgattacaggaaaagacccaaacgacagcatgttcatcagtttggttgttctgctgtattctattttgctgccggtgttttggcgcggttatcttatcggaaaaaggatctgcggaatcagaatcgtaaaaaaagacggatcacaggtcagtctgttaacaatgtttttacgggttattgtagccggcctggtttacgttataaccttcggactcggcttgatcgccagcctgattctgattgccgtacgagaagacaaacggaccctgcatgatttaatcgcgggaacatatgtcacttatgcgacaccaggtgaagaagaacttaatgctgacgaagagattagaaagagcgaataatggttcgctctttttatttttatgcataaaaaatacaaggcagcaaaacatatgaaaaataggattggaggaataaactggatgaaacgaataaccatcaacattatcacaatgttcattgcagcggctgtcatttctctgaccggtacagctgaggccgctgaaaaacagcagcagccacccgcaaatgttacactgacagatcagcaaaagaaagagattgaacaactggaagcagagattcttaaaaagcgcaaagacgtgatctcaaagtatgtacaatacggtatcctgcctaaagaaagaggagaacacatcaaaaatcacttggacaaacactttgaaatgatgaaacaaaacggctttgttccaaagcaccatcctcatccgcataaatttgaaaaaagacattaaaatggtaagcatccaattggaattgggtgcttttttattgttaaaagttactgaatgaattttccggaaaaatatatcgcttttgttgattatatcttataataagatataaatggggtgtataatgatggaaatggatttaatctctaaacttaatcagcagtggacagatatttattatttattacattatcaacataaagataatatttctcaccaggcaatacggattatgcagcatattgaaaagcaaggtgaggcaacaataggagctttggctgaatacttgtctgtctctcacaatacggcgtcagagcatactaaacgtttgattcaaaagggatttatagctaaacggcgaagtcaacaggatgaacgaaaagttttagttttcttaacacaagaaggaagatctgttcttgaacagcatacacagctagataaagagaaattaaaagaaataattgaacgaatgagcacatcagaaaagaaattacttgaacaggcatttgaacttttaagtagggaagctaaacaatggcagttttaagtaaagtaatcatctctgcgttgattatcggttttgttactgaaatatcaaaaagacatccgacctatggcggcatcattgctgctttgcccttggtcagcttattaagccttttttggatgcaaatacaaggtgaaaaaacagctcaattaagtcaatttgcatctggtgtgcttacaggaatcccagctacagtttgtttactagctattttggcttttttgctgaaaattcatgtgccgttttggtttgcattatgtgttggaatactaggatgggctatgtttttatggatgcagaagatctttctcaatatattatttaactgagtatagaaaggagatgctatgtttttaaaaaaggttactcttcttcgagataggattttggactttgacagatttccttttactatcccggctataagtcaattaaatgacatcttatttactagccaagtgactttttttgtggggaaaatggatctggaaaatctactttgcttgaagcgatagcagataagtgtgaattcaatacagcgggcggaagccgaaataatgtctatgaattacgggagtcagattcccatttaggagattacatacgtttatcttggcttccaaaggtaacaaatggcttcttcttaagggctgaatcgttttatcatctttctcttcatctggatgagatggaactagatgctcctcagccataccgttcctatggagggaggccgctacacaatcaatcacatggagagtcctttatgtctctattccgtcatcgttttaaagagaaagcgatttaccttttagatgagccagaagcagcactttctccagctagacaattagcttttttgagagttatacatgatttggtgaagggcggaaatgtacagatgatcattgcgactcactccccaatcctactgggctatcccaatgctaatattttaagctttgatggtggaagaatacatcatattgaatatgagaatacagagcatgttcaattaacacgatattttcttggacaaagagaaaaaatattagctgagctgttccgcgactaacatcgagttgatatgaaacgcgtttcatagcctatgataggtttatcaataattcaggagtgataaaaactatgatccaccagcatccagaatcttttccgaaacattttttgtgggctctgcttcagcagcgtaccagattgaaggcgcttggaatgaagatggcaaaggcccttctgtttgggatgtgtttacgaaaataccgggcaaaacgtttaaaggaaccaatggcgagattgcggttgaccattatcaccgatttaaagaagatgtcgctctgatggctgagatggggttaaaagcatatcgattttccgtcagctggccacgggtttttccaaaaggaaaaggagagatcaatgaagcaggtctagcgttttacgatagtctgattgatgaattgctttctcatcacatcgagccggttctgactttatatcactgggatttgcctcaagcgcttatggacgaatacggcgggtttgaatccagaaacatcatagaggattttaatcactactgtattactctttataaacgttttggagacagggtgaaatattgggttacgttaaatgaacagaactacaattttaatcacggatttattacagccatgcatccgcctggagtgaaagacagaaaacgattttacgaagcaaatcatattgcgtttctggctaatgcaaaagccatcgaatcatttagagaatatgtgcctgaaggcaaaataggtcctagctttgcttattctccggcttaccctttatcaagccatccagaggatatactggcatttgaaaacgccgaagaatttatgaacaattggtggcttgacatgtattgctggggaacctacccgcaaattccattccgctacttggaaaaacagggatgggcgccgaaaatcgaagcaggagatatggagctgcttgccaaagggaagcctgattttataggtgtcaattattatcagacgatcacctatgaacgaaatccgcttgatggtgtgtctgaagggaaaatgaatacgacaggccaaaagggaaccaatcaggagacggggatacccggagtgttcaaaacgaaaaaaaatccgcatctgacaacgagcaactgggattggacaattgacccaattgggctgcgtatcggtcttcgccgaattacaagccgctatcagcttccagtgtttataacagagaacggtttgggtgaatttgataaagttgagaacggcactgtacaggatgattatcgaattgattatttgcgttcgcatcttgagcaatgcagacaagccatcagtgacggtgtcgatttaatcggctattgcagctggtcgtttactgatctgttaagctggctgaacggctaccaaaaaagatacggatttgtatatgtcaatcgtgatgaagaaagcacatacgatttaaaacgcttgaagaaaaaaagcttttattggtatcaagatgtcatcaagacaaacggagaaagtatataaagagtccctgagagttattctctcaggggtttttcattacacagaaacagcatcaataatataagtgtcggcgtgcaaatctgacatttcagccggcacagtccagcatgtcaattgatagtctcctttaggcagatcaaaggacagtcttttagacatgatgctttcaatatgaattccgttttctgtgacatgaaaaggaacagtcacttttgtttcgtaggagtttactgtttctgaactgttcaggcgcaaaagaataaaggcctttgtatttcgctgtgcctcaaaggaaatggctccgtctgccgcagcatatcctttttcaatcgcttcgtcagtccaatccattacaggaggtgtagaatccttttgaaatacagtaaattgatgatatgaaatcgaaagttcttgcggcttccatgatttgatcaatgtgctgttcctcctctatgtactgtttactgaattgtgaataaaacctttgtgccgtctgggtaatcggtaagctgatgcccgacccaagagcctgctccgcggttgtcagcgggagaaatgtattctacagaagctccctcaccgccttctttgcacatggccattggccattcatctctgtcatacccctttttggaaggtacgtcctttaatgattgctcgcggcgttcctcagctccgtctctgtcgatagtgcacacctctgagtgcccctcatttatcgcatccttaatatgcttggccgtttcgggataacggtcagaagggaaggagattgtttcatcatattctttcgtttgagacgttttttgatcagctgagaaaaagtctccttttatcaggccgacagctgcagctgctatgatgacgatgacgagaagtattgtttttatgatgtccgtcgtgatgttcacctcccgcttttaaaactgacacaagagtaatccagaaagcatttggtgtaaaggtttaaattttatgttttacgctcagtttattgcaaaaatcgtaattttagcaggtcgaaatatttgttttcagcaaaatacgattgccaatttacaataatgatagtaagtcatcagccgttttcggcttgattaatcattttaaattggcttatgataccggtaagctcctcagctaattgagaaagtgtttcagaagctgcggtaatctcctccattgcagcaaattgctcctctgttaatgcagccgcttgccgggtatttttagtagattctttaatgtcggccgtattggctgcaaaggaatcatttatatgatgtgcactggctgaaatgtttgttacagatgctgataaatcactaatctcggcgctgatttcacctgttgcagctgcaatttccttaaatgcatctctggtgcgctggatcatggtgaccccttctgcagcttctgttttcacatgctcaacagatcttgcagaccggttcatatcattttgtatttctatgatcagttttgaaatctgccccgcagactgttgagactcttccgctaatttacgtacttcatcagcaacaacagcaaagccttttccttgttcaccggctctggcagcttcaattgctgcattcagcgcaagcaggtttgtctgatcggcaatttgggtgatgaccgataaaatttgctcaatttgtttagagcggccgtctaactggtgtatgatttctccgcttttctgaattgactggtgaatcgcatccatttgcgcctgtacatttgcaatttccttttgcccaatgtctgcttttgattgcgcgagctgccctttgtcagcgatagcggcagtatttgcagaaatatcccggatgtctgctgaagcttgttttaatgagctttcactgttttcaattcgggtgatctgatcttgggctccatttgcaatctgctgtacagcttctgtgatcttttctgaagcttgatttgtttcctctgctccggctgagagctgctgagaggctgacgcaagctgaagggctgattgttgtacggtttgtatggtatcgttcagcttcattctcatcttattataatagacgcttagttctgatagctcgtcaccggttttgtctgacacctctattgtcatatctccgtttccggcactttcaaaggcgctttttaaagcgttcagccgcttgttgatttttctggtgaaaaccaagacaaggatgactgataccataatgacgataacaagaacgatagcgaattgagtgaaaagtgattgtgtaagtgatgttaaaatactttgattagctccggtatacagcatgccgatgatgttcccattttgatcttttaacggcatgtatgcagtctgataagaagaacctgctacatctgcttgtccgtaaaaacgctttcctttctttaaaacagcggcaataacttcagaagaagcctgggtgccgacagctctttcgccattcttcatgacattggttgcaacacgagtatcgccttggaaaatggtaatggtatcacctgttttttcgccaagcagatcaacaatatcttcatttccattgatttgtgtttgccctttatagagcttattgtttttcacctgccagtcgcctgacatgacatcatcaatataagtgctgcttaaagcgagatcacctttcgctttttcagttgccatttgtttcatgctttctgtaatttccttaagcatcacagtgccaactgatgccgaaaacaaaagaatcaccacgaaaacgaggcaaagaattttagttcctagcttcatctcaagtcgttttatcaacataattcctccctttatgatttgtaggtcatattacttatcgggtttttgggtttaaagttttattttagaaaaaataaaaccggcctgatcttcaggccggtttgtgtgatgctattcaaggtttgcgtggtgagtgaacatagtttcagaatcgagtccttttttctccatgagttttaaaatcactgcatcatagaatagcagcaaagtttgttcaaataatgatcccattggctgaatggttttatagcttccgtttgactggtctttaggagaaccaggcattctgatgatgaggtccgcttgttttccgatgcttgattccggattgatggttaaagcggcaacaattccgtgtaagctttttgcttttgctgcggtatgaatcaagctttttgtctcgcctgatcctgagccgataataactagatctcctttggcgagcggcggagtgagaatctcacctacaatatgggcgttgaagcccatgtgcatcagtctcatcgcgaaggattttgccatcaggccagaccgccccgcacccgcggtgaaaatttggtgggatgaaagaatgtgatcggcaagctggtcagcttcttcattagaaatataagctactgaattgtgtaactcattgagaatttccgctacgtattcagtcgttttcataggagttatccttggacaatcagctgcttcatttttgaagctgtttcagccttatcagctgcgcttgtaattccgcccccaacaatgacaaggtcagggttttgcttgatcacttctggcagtgtatcaagtttgatgccgcccgcgattgcggtttttgcgttttttacggtatttttgattgtcgttaattcttcgaaagagtttttgccctctgcttgaagatcatagccagtgtggacgcagatgtagtcaacgcctagtgcgtcaatttctttcgcacgggattcgatatctttcacgttaatcatgtccactaagattttcttcttttgttttttggcttcttctactgcgcctttaatcgttgcatcgtctgtagcccctaaaacggtgatgatgtcagcgcctgcttccgacgctttcataatttcgtagcctccggcatccatgattttcaggtctgcaagaaccttcaattgaggaaatgcttcttttatttctttaacggctcttaggccttcattaatgacgaccggtgttccgatttcaactacgtcgatgtattgttctacctctttgacgagctcaatggcttccgggatgttgacgaggtctaatgcaagctgtaattccattgttgatccactccctttttcgaattatttttcattctataggttctcttatttgatgagaagtaggcactttgaagtcaacaagttacttggaggatactgtgaggagagacaatcagatttctttcgcttgattttatgagtgagtataatgaaaaaagagtctgcaaaaaaagtaagtaagtgatgatacgtatctaacatacaaaaaggttactaaggggggattctattgagccggatggacgacaaaaggtttaattgtgagaaggaattaacgcttgcagtgattggcggtaaatggaagatgctcattttatggcatttaggaaaagaaggcacaaagcggttcaatgaattaaaaacattgattcctgatattacgcagaagatcctcgtgaatcagctgagagagcttgagcaggatatgattgttcacagggaagtgtatccggttgtcccgccgaaggttgagtattctctgaccccgcatggagaaagcctcatgcctattcttgaagcgatgtatgagtgggggaaaggctatatggaattgattgatatcgacaaaaatgtcatgaaagaatcgttgtaagacgctcttcgcaagggtgtcttttttttgcctttttttcggtttttgcgcggtacacatagtcatgtaaagattgtaaattgcattcagcaataaaaaaagattgaacgcagcagtttggtttaaaaatttttatttttctgtaaataatgtttagtggaaatgattgcggcatcccgcaaaaatatccctgtaaataaactggaatctttcggcatcccgcatgaaacttttcacccatttttcggtgataaaaacatttttttcatttaaagtgaacggtagtaagataaaaaatattgaaaacaatgaataaatagacaaaattgtttcctattaggataggggatcttgcggtctttatccacttatgttaaacgccgcaatgctgactggcggctgcccgttttaatagcggcaatctgtttttttgtttggaagctctgctttttaagtgtagtactttgggctatttcggctgttagttcataagaattaaaagctgatatggataagaaagagaaaatgcgttgcacatgttcactgcttataaagattaggggaggtatgacaatatggaaataactttttaccctttaacggatgcacaaaaacgaatttggtatacagaaaaattttatcctcacacgagcatttcaaatcttgcggggattggtaagctggtttcagctgatgcgattgattatgtacttgttgagcaggcgattcaagagtttattcgcagaaatgaagccatgcgccttcggttgcggctagatgaaaacggggagcctgttcaatatattagcgagtatcggcctgttgatataaaacatactgacactactgaagatccgaatgcgatagagtttatttcacaatggagccgggaggaaacgaagaaaccgttgccgctgtacgattgtgatttgttccgtttttccttgttcaccataaaggaaaatgaagtgtggttttacgcaaatgttcatcacgtgatttctgatggtatctccatgaatattctcgggaatgcgatcatgcacatttatttagaattagccagcggctcagagacaaaagaaggaatctcgcattcatttatcgatcatgttttatctgaacaggactatgctcaatcgaagcggtttgaaaaggacaaggcgttttggaacaaacaatttgaatcggtgcctgaacttgtttccctgaaacggaatgcttccgcaggaggaagtttagatgctgagaggttctctaaagatgtgcctgaagcgcttcatcagcagattctgtcattttgtgaggcgaataaagtcagtgttctttcggtatttcaatcgttgctcgccgcctatttgtacagggtcagcggccagaatgatgttgtgacgggaacctttatgggcaaccggacaaatgcgaaagagaagcagatgcttggcatgtttgtttctacggttccgcttcggacaaacattgacggcgggcaggcgtttttagaatttgtcaaagaccggatgaaggatctcatgaagacactccgccaccaaaagtacccgtataatctcctgatcaacgatttgcgtgaaacaaagagctctctgaccaagctgtttactgtttctcttgaatatcaggtgatgcagtggcagaaagaagaggatcttgcctttttgactgagccgattttcagcggcagcggattaaatgatgtctcgatccatgtgaaggatcgatgggatactgggaaactcaccatagattttgattaccgcactgatttattttcacgtgaagaaatcaacattatttgtgagcgcatgattacaatgctggagaacgcgttaacgcatccagaacatacaattgatgaattaacgatgatttctgatgcggagaaagaaaagctgcttgcgagggccggcggtaaatctgtgagctaccgtaaggacatgacgatcccggaactgttccaagaaaaggctgagcagctttcagatcatccggcggttgtatttgaagatcgtacattgtcctatcgaacgttacatgaacaatcggcacgcatcgccaatgtgctgaaacagaaaggggttggcccggacagtcctgtcgcggttttgattgaacgctctgaacggatgattacagctatcatggggattttaaaagccggcggagcctatgtgccgattgatccgggttttcctgctgagcgcattcaatatattttggaggactgcggggcggacttcatcctgactgaatcgaaggttgcggcgcctgaagccgatgctgagctgattgacttagatcaggcaattgcagaaggtgcagaagaaagcctgaatgcagatgtgaacgcacggaaccttgcctacattatttacacatcgggaacaaccggacgtccgaaaggcgttatgatcgagcatcgccaagttcatcatttggttgaatctctgcagcagacgatttatcaaagcggcagccaaaccctgcggatggcattgcttgcgccgttccacttcgatgcgtcagtgaagcagatcttcgcgtcgcttcttttgggacaaaccctttatatcgtaccgaagaaaacagtgacgaacggggccgcccttgctgcatattatcggagaaacagcattgaggcgacggatggaacaccggctcatttgcaaatgctggtagcagcgggcgattttgaaggcctaacactgaaacacatgctgatcggaggagaaggcctgtcatctgttgttgcggacaagctgctgaagctgtttaaagaagccggcacagcgccgcgtttgaccaatgtgtacggaccgactgaaacatgcgttgacgcgtctgttcatccggttatccctgagaatgcagttcaatcagcgtatgtgccgatcgggaaagcgctggggaataaccgcttatatattttggatcaaaaaggccggctgcagcctgaaggcgtggcgggcgagctttatatcgcgggagacggtgtgggccgaggctatttacatttgcctgaattaacggaagagaagtttttacaagatccattcgtgccgggcgatcgcatgtaccggaccggggatgtggtacgctggcttccagatggaacaatcgaatatttaggcagagaggatgaccaggtcaaagtccgcggataccggattgagcttggggaaattgaagccgtgattcagcaggcgccagacgttgcaaaagccgttgttttggcacgccctgacgaacagggaaatcttgaggtttgcgcatatgttgtgcagaagcctgaaagcgaatttgcgccagccggcttgagggcgcatgcggccagacagcttcctgactatatggtgccggcttactttacagaagtgacagaaattccgcttacgccaagcggcaaagtcgaccgccgcaagctgtttgcactagaggtgaaggctgtcagcggcactgcctttacagcgccgcgaaatgagactgaaaaagcaatcgcagccatttggcaggacgtactgaacgttgagaaggcggggatctttgacaatttctttgaaactggcgggcattcattgaaagccatgacccttttaacaaagattcataaggaaacaggcgtcgagattccgcttcaatatttgtttgagcatccgacgattgcggctcttgcagaggaggctgatcacagagaaagccgggcgttttcggtgattgaacctgctgaaaaacaggagcattacccgctttccctggcacagcagcgaacatatatcgtcagccagttcgaggatgcgggagtcggctacaacatgccggcagcagcaattctggaagggcctttagatattcaaaagctggagcgcgcatttcagggattaatccgacgccacgagtcattgagaacatcatttgttcttgaaaacagcacgccgagacagaacattcacgatagcgttgatttcaacatcgaaatgattgaaagaggcggccgctcagatgaggcaattatggcttcattcgttcggaaatttgatttggcgaaagctccgctattcagaatcggtttgctggggcttgaagagaaccgtcatatgctgctgtttgacatgcaccatttgatttctgatggtgtatccattggcattatgctggaggagttagcacgcatttataaaggcgaacagcttcctgaacttcgtctccagtataaggactacgctgtatggcaaagcagacaggctgctgaagggtacaagaaggaccaggcttattggaaggaagtctttgcaggcgagctcccggtgcttcagcttctgtccgattacccaagaccgcctgttcaaagctttgaaggggatcgggtgtcaatcaagctggatgcgggggtaaaggatcgcctcaatcgtttggctgaacaaaacggcgccactttatatatggtgatgctgtccgcttactatacgcttttgtcaaagtatacggggcaggatgacatcattgtcgggacaccgtcagcgggcagaaatcactccgatacagagggcattatcgggatgttcgtcaatacgcttgcgattcgcagtgaggtgaagcaggatgagacgtttacccaattgatctcgcgtgtccgcaaacgggtgctgaatgccttttctcatcaggactatccgtttgagtggcttgttgaagatttgaacatcccgcgtgatgttagcaggcatccgctgtttgacacgatgttcagccttcaaaacgcgacagagggcattccggctgtcggcgatctgtccttgtctgttcatgagaccaatttcaagattgccaaatttgatttgacggtgcaggcgagagaaaccgatgaaggcattgagcttgatttggattatagcacgaagctgtttaaacaaagcacggcaaacaggctgcttacgcattttgcgcgtttgcttgaagatgctgcggctgatccggagaagccgatttctgagtataagcttctttctgaagaggaggctgcttcgcaaattcagcagtttaacccgggcagaacaccttatccgaaagacaaaacaattgttcagctgtttgaggagcaagcggcgaaaacgccagatcacccggcgcttcaatatgaaggcgaatcactcacttatcgtgagctgaatgaacgggccaatcgtttagcccgcggcattctttctcttggggctggcgaaggcaggacagcggctgtcttatgcgagcggtcaatggatatgattgtgtcgatcttggcagtattaaaatcaggttcggcttatgttccgattgatccggaacatccgattcagcggatgcagcatttcttccgtgacagcggagcaaaggtgcttctcactcagaggaaattaaaggctttagcggaagaagcggaatttaagggcgttatcgtgctagccgatgaggaagagagctatcatgccgatgcgcgaaatctcgcactgcctcttgattctgaagcaatggccaacctgacgtatacctctggaacgactggaacacctaaggggaatatcgtgacacatgccaatattctccgcacggtgaaggaaacgaattatctcagcattacagaacaggatacgattctcggtctttccaattacgtgtttgacgcgtttatgttcgatatgttcggatctttgttaaacggagccaagctggtgctgataccgaaggaaaccgttttggacatggctcgtctgtcccgcgtcattgaacgggagaacatcagcattctcatgattacaaccgctttgttccacttgcttgtggacttgaatccggcgtgcttgtcaacgcttcgcaagattatgtttggcggggaacgggcttcggttgagcatgtcagaaaagctttgcaaacggttggaaagggcaagctccttcacatgtatggaccgtctgaaagcacggttttcgcgacgtatcatccggttgatgaattggaggagcacacgctgtctgttccgattggaaaaccggtcagcaatacggaagtatacattcttgcccgtacgggacacgtgcagcctgccggaattgccggagagctttgcgtcagcggcgaaggactcgtgaaaggctattacaaccgtccagaactgactgaggagaaatttgttccccatccgtttacatccggcgaacgcatgtataaaacgggagaccttgcgagatggctgccgaatggcgacatcgaatttatcgggcgaatcgaccatcaggtgaagattcgcggacagcgcatcgagcttggagaaatcgaacatcagctgcaaacccatgatcgtgttcaggagagtgttgtgcttgccgttgatcaaggagcgggagataaactgctttgcgcttactatgtcggagcgggagacatctcatcacaagagatgagagagcatgctgcgaaggacttgccggcatatatggttcctgcggtgtttatccaaatggacgagctgccgctgacagggaacggaaaaattgaccggagagcgctgccgattcctgatgccaacgtttcaagaggtgtttcatatgttgcgccacgcaatgaaacggaacaaaaagtcgcagacatttgggcacaggtgcttcaggctgaacaagtcggcgtttatgaccacttctttgacattggcggacattcattagcaggcatgaagatgcttgccttggttcatcaggaactgggcgttgagctgtcactcaaggatctcttccagtcaccgacggttgagggcttggcacaggtgattgcctccgctgaaaaagggacagccgcaagtatcagcccggcagagaaacaagatacgtatcctgtttcttcaccgcaaaaacggatgtacgtgcttcagcagcttgaagatgcgcaaacgagctataacatgccggcggttctgcgcctgacaggtgagcttgatgttgaaaggcttaacagcgtcatgcagcagttaatgcagcgtcatgaagccttgagaaccacgtttgaaataaaagatggagaaacggtgcagcggatctgggaagaggctgagtgtgagatagcctatttcgaagccacggaagaagagacagagcggatcgtttctgagtttattaagcctttcaaaatcgaccaacttccactgttcagaatagggcttatcaagcattcagacactgagcatgtgctgctgttcgatatgcatcatattatttctgacggtgcatctgtcggtgtgctgattgaggagctttcaaagctgtacgacggagaaacccttgagccgctccgtattcaatataaggattatgccgtgtggcagcagcagttcattcagtctgagctttacaagaagcaagaagagcattggctgaaggagctggacggagagctgccggtgctgacgcttccgactgattacagtcggcctgccgttcaaacatttgagggagaccgcattgcattttcattagaagcaggcaaagctgatgctctgcgcaggcttgcaaaagaaacggattccacgctttacatggtgcttctggcttcatacagtgcatttttatcaaaacttagcgggcaagacgatatcatcgtcggttcacctgtggccggacgatctcaagcggacgtcagccgcgtcatcggaatgttcgtcaatacattggcgctgcgcacgtatccgaagggtgaaaagacgtttgccaactatcttaacgaagtgaaagaaacggcactcagcgcttttgatgcgcaggattacccacttgaggatttgatcggaaatgttcaggttcagcgtgacacaagcagaaacccgttattcgatgcagttttttcaatgcaaaatgcgaatataaaggatttaacaatgaaggggattcagcttgagccgcatccgtttgaacggaaaacagccaagtttgacctcacgctgacggctgacgaaaccgacggagggcttacattcgtactcgaatacaatacagctctgtttaagcaggaaacgattgaacgatggaagcaatattggatggagcttttagatgcagttactgggaacccgaaccagccgctttccagcctgtcactggtcaccgagacagaaaagcaagcgcttcttgaggcatggaagggcaaggcgctgcctgtgccgacagacaaaacagttcatcagctattcgaagagactgtccagcgccacaaagaccgcccggctgtcacatacaacggccagtcttggacgtacggcgagctgaatgcgaaggcaaaccgtctcgcgcggattctgatggactgcggcatcagcccggatgaccgcgtcggcattctcacgaagccgtcgcttgaaatgtccgccgcggtgctcggcgtcttgaaagccggagcggcgtttgtgccgattgatcctgactacccggatcagcggattgagtatattttacaggacagcggcgcgaagcttctcttgaaacaggaaggcatttcagtgccggacagctttacgggagatgtcattcttctcgacggaagccgcacgattctaagcctgccgcttgatgaaaacgacgagggaaatccagaaaccgctgtaaccgcggagaacttggcgtacatgatttacacgtctggaacgaccggacagccgaagggtgtcatggtcgagcaccatgcgcttgtgaacctgtgcttctggcaccacgacgcgttcagcatgacagcggaggaccgcagtgcgaagtacgcgggctttgggttcgacgcttccatttgggagatgttcccgacttgggcgatcggcgctgagcttcacgtcattgatgaagcgatccgcctcgatatcgtccgcctgaacgattattttgaaacgaacggcgtaacgatcacgttcctgccgacacagcttgcggaacagttcatggagcttgagaacacatcacttcgcgtcctcttgaccggaggagacaagctgaagcgcgcagtgaaaaagccgtacacactcgtcaacaactacgggccgacagaaaatacggtcgttgccacaagcgcagaaatccatccggaggaaggctcgctttccatcggaagggccattgccaatacgagagtatacattctcggcgagggcaatcaggtgcagccggaaggcgtagccggagagctttgcgtggcggggcgcggactggcacgaggctatctgaatcgagaagacgaaaccgcgaagcggtttgtcgctgatccgtttgtgccgggtgagcgcatgtaccgcaccggcgatttggtgaagtggacaggcggcggcatcgaatacatcggccggatcgaccagcaggtcaaggtccgcggctaccggatcgagctctcagaaattgaagtccagctcgcacagctttctgaggtgcaggatgcggcggtgacagctgtcaaagataaaggaggcaacacagcgatcgcggcgtatgtcacaccggaaacagctaacatagaagcactgaaatcagcactgaaggaaaccctgccggattacatgatcccggcgttctgggtgacgctggacgagcttccggttacggcaaacggcaaagtggaccgcaaagccttgcctgagccggacatcgaggcgggaagcggagaatacaaagcgccgacgaccgacatggaagagctgcttgccggcatctggcaggacgtgcttggaatgtctgaagtcggtgtcaccgacaatttcttctcgcttggcggagattccatcaaaggaattcaaatggcgagccgcttgaaccagcacggctggaagctggaaatgaaagatctcttccagcacccgacgatcgaagagcttacccaatatgtagagcgtgccgaaggcaaacaggcagaccaaggtccggtggagggcgaagtcatcctgacgccgatccagcgctggttctttgaaaagaacttcacgaacaagcaccactggaaccaatcggtgatgcttcacgccaagaagggctttgatcctgaacgggtggagaaaacattgcaggcgctgatcgagcatcatgacgcgctccgtatggtctaccgtgaaggactggaagacgtcattcaatacaacaaaggtcttgaagctgcttcagctcaattggaggtcattcagattgagggccaagctgcagattacgaagaccgtatagagagagaagcggagcgtttgcaaagcagcatcgacttgcaggaaggcggtttgttaaaagcaggcttgttccaagcggaagacggagatcacttgcttcttgccattcaccacttagtggttgacggcgtgtcgtggcggattttactggaggatttcgccgcggtatacacacagcttgagcaaggcaatgaaccggttctcccgcagaaaacacattcatttgcagagtatgcagagagattgcaagacttcgcgaactccaaagcctttttgaaagaaaaagagtattggagacagcttgaagaacaagctgttgcggcaaagcttccgaaagaccgcgaatctggtgatcagcgaatgaaacatacaaagacaattgaattctcgctgactgctgaagagacagaacagctcaccacaaaggtgcatgaggcatatcacacagaaatgaatgatattttgctgacggcattcggattggcaatgaaggagtggacgggtcaagatcgagtaagtgttcatttagaggggcatggacgtgaagaaatcatagaagacctgaccatttcccgcacagtcggctggtttacaagtatgtaccccatggtgctcgatatgaagcatgcggatgatctgggctaccagctgaagcaaatgaaagaagatatcagacatgtgccgaataagggagtcggatacggcattctgcgctatctgacggcaccggaacataaagaagatgtggcgttctcgattcagccggatgtcagcttcaactatttaggtcagtttgacgaaatgtcggatgcaggtttgtttacgagatcagagctgccgtcaggacagtcattaagccctgaaacagaaaaaccgaatgcgctggatgttgtcggatatatcgaaaacggaaaactgacgatgtcactggcctatcattctcttgaatttcatgaaaaaacagtacaaacattcagtgacagctttaaagcgcatcttctcagaatcattgaacattgcctatctcaagacggtacggaactgaccccgagtgatcttggtgacgacgatttgacgctggatgagctggataaattaatggaaattttctaatagaggtggcatatgagcaaaaaatcgattcaaaaggtgtacgcactgacaccaatgcaggagggaatgctgtatcatgcgatgcttgatccgcattcttcctcgtacttcacacaattagagcttgggattcacggcgcttttgatcttgaaatctttgagaaaagcgtcaatgaactgattcggtcatacgatattctccgtacggtatttgtgcatcagcagctgcaaaaaccgcgtcaggtcgtgttagcggaacgcaaaacaaaggtgcattatgaggatatcagtcatgcagacgagaaccgccagaaagagcacattgagcgttacaaacaagacgttcagcgccaaggctttaacctggcaaaagacatattgttcaaggtagcggttttccgccttgatgcagatcagctgtatcttgtctggagcaatcatcatattatgatggacggctggagcatgggcgtcctcatgaaaagcctgttccaaaactatgaagcgctcagagcaggaaggacacctgcaaacggtcaaggcaagccttactccgactacatcaaatggcttggaaaacaggacaatgaagaagcggagagctactggagcgagcgcttggcgggttttgaacagccaagcgtgctcccgggccgcctgcctgtgaaaaaagacgaatacgtcaataaagaatattcctttacatgggacgaaacattggttgcccgtattcagcaaaccgcaaatctccatcaagtgacagggcctaacctatttcaggccgtttggggcattgttctcagcaaatacaactttacggatgatgttgtcttcggaacggtcgtctcaggaaggccgtctgaaatcaacggaattgaaacgatggcggggctgtttatcaacaccattccggtgcgggtaaaagttgaacgagatgctgcattcgctgatattttcacagctgttcagcagcatgcagtagaggcagagcgttacgattacgtgccgctctatgagattcaaaaacgctcagcccttgatggcaatctcttaaaccatctggtcgcgtttgaaaattatccgcttgatcaagagcttgaaaacggcagcatggaagaccgcctcgggttttcgattaaggtagaaagcgcatttgaacaaacgagcttcgatttcaacctgattgtgtatccgggcaaaacgtggaccgtcaaaattaaatataacggagccgcctttgattccgcttttatcgaacggacagcggagcaccttacccgcatgatggaagcagctgtcgatcagccggccgcttttgtgcgtgagtacgggcttgttggagacgaagagcagcggcaaattgtcgaggtgtttaacagcacgaaagccgaactccctgaaggaatggctgttcatcaggtgtttgaagagcaagcgaaacggacgccggcgagcactgccgtcgtatatgaaggaaccgagctgacgtaccgcgagctgaatgcagcggctaaccgtctggcgaaaaagcttgtcgaacaagggcttcaaaaaggggaaacagcagcgattatgaacgaccgctcagtagaaaccgttgtcggcatgctggctgttttaaaagcaggcgccgcatatgtgccgcttgatccagcgcttcctggggatcgtcttcgtttcatggcagaggacagctccgttcgaatggttttgaccggaaattcttatacagggcaggcacatcagctgcaagtgccggttcttacactggacataggttttgaagagagtgaagtggctgacaatctcagcctgccatccgccccgtccgacttggcgtacatcatgtacacatctggttcaacgggcaaaccgaaaggcgtcatgatcgaacataaaagcattctgcgcctcgtcaaaaatgccgggtacgttcctgttactgaagaggaccgcatggcgcaaacgggagctgtcagctttgatgccggaacgtttgaggtattcggcgcactgttgaatggcgcagcgctttatccggtcaaaaaagagacgctgcttgatgcgaaacaatttgctgcattcctgcgtgagcaaagaatctcgacgatgtggctgacatcacctttattcaaccagcttgccgcaaaggatgcgggtatgttcggcacactgcgccatttaatcatcggcggagatgcccttgtccctcatattgtcagcaaagtaaaacaggcatctccgtcgctttcattgtggaacggatacggcccgacagaaaacacgacgttttcaaccagttttctgatcgaccgtgagtatggcggctctatcccaatcgggaagccgatcggaaattccactgcctacatcatggatgagcagcaatgcctgcagccaatcggcgcgcctggtgagctttgcgtaggcggaatcggtgtagcgcgtgggtatgtcaatctcactgagctgacagaaaagcaatttctcgaagacccgttcagaccgggtgagagaatttatcgcactggtgacttggcaagatggctgccggacggcaatatcgaatttttaggcagaatcgacaaccaagtaaaggtgcgcggcttccgaattgagcttggcgaaattgaaacaaaactgaacatggctgagcatgtgacagaggctgcggtgatcatccgcaagaacaaagcggatgaaaatgaaatttgcgcgtacttcacagcggatcgtgaagtggctgtgagtgagctgagaaaaacactgtctcagtctttgcctgactatatggtccctgcccacctgattcaaatggacagcctgccgcttacgccaaacgggaaaatcaacaaaaaggaactgcctgcaccgcaatcagaagccgtgcagccggaatacgcagcaccaaaaacagagagtgaaaagaaattagcggagatctgggaaggaatactcggcgtcaaagcaggcgttaccgataacttctttatgatcggcggccattctttgaaagcgatgatgatgacggcgaaaattcaagagcattttcataaggaagttccgataaaagtgctttttgaaaagccgactattcaagaactggcactgtatttggaagagaacgaaagcaaggaggagcagacgtttgaatcgatcaggcaagcatcttatcagcagcattatcctgtatccccggcccagcggagaatgtatattctcaatcagcttggacaagcaaacacaagctacaacgtccccgctgtacttctgctggagggagaagtagataaagaccggcttgaaaacgcgattcagcaattaatcaaccggcacgaaatcctccgtacatcgtttgacatgatcgacggagaggttgtgcaaaccgttcataaaaacatatcgttccagctggaggctgccaagggacgggaagaagacgcggaagaaataatcaaagaatttgttcagctgtttgaattaaaccgcgcgccgctcgtccgttcgaagcttgtccagctggaagaaaaacgctacctgctgctcattgatatgcatcatattattactgacggaagttcaacaggcattctaatcggtgatcttgccaaaatatatcaaggcgcagatctggaactgccacaaattcactataaagattacgcagtttggcacaaagaacaaactaattatcaaaaagatgaggaatactggctcgatgtctttaaaggcgaactgccaatactggatcttcccgcggatttcgagcggcctgctgaacggagctttgcgggagagcgcgtgatgtttgggcttgataagcaaatcacggctcaaatcaaatcactcatggcagaaacagatacgacaatgtacatgtttttgctggcggcgttcaatgtactcctttccaagtacgcgtcacaggatgatatcattgtcggctcgccgacagctggcagaacacatcctgatctgcaaggtgtgccgggtatgtttgtcaacacggtggcactcagaacggcaccaacgggagataaaaccttcgcgcaattccttgaagaggtcaaaacagccagccttcaagcattcgagcaccagagctatccgcttgaggagctgattgaaaagcttccgcttacaagggatacaagcagaagtccgctgttcagcgtgatgttcaacatgcagaatatggagattccttcattaagattaggagatttgaagatttcctcgtattccatgcttcatcatgttgcgaaatttgatctttccttggaagcggtcgagcgtgaagaggatatcggcctaagctttgactatgcgactgccttgtttaaggacgagacgatccgccgctggagccgccactttgtcaatatcatcaaagcggccgcggctaatccgaacgttcggctgtctgatgtagatctgctttcatctgcagaaacggctgctttgctagaagaaagacatatgactcaaattaccgaaacctttgcagcactttttgaaaaacaggcccagcaaacacctgaccattctgcggtgaaggctggcggaaatctgctgacctatcgcgagcttgatgaacaggcgaaccagctggcgcatcatcttcgtgcccaaggggcaggaaatgaagacatcgtcgcgattgttatggaccggtcagctgaagtcatgatatcgattctcggtatcatgaaggcgggggcagctttccttccgattgatcctgatacacccgaagaacgaatccgttattcattagaggacagcggagcaaaatttgcggtcgtgaatgaaagaaacatgacggctattgggcaatatgaagggacaatcgtcagccttgatgacggtaaatggagaaatgaaagcaaggagcgcccatcatccatttccgggtctcgcaatcttgcatacgtcatttatacgtccggtacgaccggaaagccaaagggcgtgcagattgagcatcgcaatctgacaaactatgtctcttggtttagtaaagaggcgagcctgacggaaaatgataagactgtattgctttcatcttacgcatttgaccttggctatacgagcatgttccccgtacttctgggcggtggcgagctccatatcgtccagaaggaaacctatacggcgccggatgaaatagcgcactatatcaaggagcatgggatcacttatatcaaactgacaccgtctctgttccatacaatagtgaacaccgccagttttgcaaaagatgcgaactttgaatccttgcgcttgatcgtcttgggaggagaaaaaatcatcccgactgatgttctcgccttctgtaagatgtatggacataccgaatttatcaatcactacggcccgacagaagcaacgatcggcgccatcgccgggcgggttgatctgtctgaaccggatgcatttgcgaaacgcccgacaatcggacggccgattacgaatgccggcgcgcttgtcttaaatgaagcattgaagcttgtgccgccgggagcgagcggacagctctatatcacgggacaggggcttgcgagagggtatctcaacaggcctcagctgacagccgagagatttgtagaaaatccatattcgccgggaagcctcatgtacaaaaccggagatgtcgtacgaagactttctgacggtacgcttgcatttatcggccgggctgatgatcaggtgaaaatccgcggctaccgcattgagccgaaagaaattgaaacggtcatgctcagcctcagcgtaattcaagaagcggttgtactagcagtttccgagggcggtcttcaagagctttgcgcgtattatacgtcggatcaagctattgaaaaagcagagctccggaaccagctttccctaacactgccgtctcatatgattcctgctttctttgtgcaggttgacgcgattccgctgacggcaaacggaaaaaccgacagaaacgctttgccgaagccgaacgcggcacaatccggaggcaaggccttggccgcaccggagacagcgcttgaagaaagcttatgccgcatttggcagaaaacgcttggcatagaagccatcggcattgacgacaattttttcgatttaggcggccattcattaaaagggatgatgctgattgccaacattcaggcggaattggagaaaagcgtaccgcttaaagcactgttcgagcagccgactgttcgccagctggcggcttatatggaggcgtctgccgtttcaggcggccatcaagtactcaaaccggctgacaagcaggctatgtatccattgtcatccgcacagaaacggatgtacgtgctcaatcagcttgaccgccagacgataagctacaacatgccatctgttcttctaatggaaggagagcttgatatttcgcgcctgcgcgattcactcaatcagcttgtgaaccgtcacgaatcattgcggacgtcatttatggaagctaatggtgagcctgttcagcgcatcattgagaaggcggaggttgatcttcatgtgtttgaagccaaagaagacgaagcggaccaaaagattaaggaatttatccggccattcgacttaaacgacgcaccgctcattcgcgcagctttgcttcgaatagaagcgaaaaaacatttgctgcttttagatatgcatcatatcatcgcagacggcgtctcaagaggcatctttgtaaaagaattggcgctgctttacaaaggagagcagcttccggagccggcgcttcattataaagatttcgccgtttggcaacatgaagctgagcaaaaagaacggatgaaggagcatgaggcgtactggatgtcagttctttcaggcgagctgccagagcttgatctcccgctcgattacgcccgtccgcctgtgcaaagctttaaaggagatacgatccgtttccgtacgggaagtgagacggcaaaggcggtagaaaaactgcttgcggaaaccggaacgaccttgcacatggtgctccatgctgttttccacgtctttttaagcaaaatttccggacagcgggatatcgtcatcggctccgttactgccggccggacgaatgctgatgttcaggacatgccgggaatgttcgtcaatacacttgccctgagaatggaagcgaaagaacagcaaacatttgcggagcttttggagcaagcaaagcagacgaacttgtcagcgcttgagcatcaggagtatccgtttgaagatctggttaatcagcttgatctccctcgggatatgagccgaaacccattgtttaatgtgatggtgacgacagaaaaccctgataaagaacagcttacattgcaaaatctgagcatttcaccttatgaggctcatcagggaacttctaagtttgatctgacactgggcggatttactgatgaaaatggcattggcttgcagctcgaatatgcgacggatctgttcgcaaaagaaacagctgaaaaatggagcgaatacgttctgcggctactaaaggctgttgcggataacccgaaccagccgctttccagcctgtcactggtcaccgagacagaaaagcaagcgcttcttgaggcatggaagggcaaagcgctgcctgtgccgagagacaaaacggttcatcagctattcgaagagactgtccagcgccacaaagaccgcccggctgtcacatacaacggccagtcttggacgtacggcgagctgaatgcgaaggcaaaccgtctcgcgcggattctgatggactgcggcatcagcccggatgaccgagtcggcgttctcacgaagccgtcgcttgaaatgtccgccgcggtgctcggcgtcttgaaagccggagcggcgtttgtgccgattgatcctgactatccggatcagcggattgagtatattttacaggacagcggcgcgagacttctcttgaaacaggaaggtatttcagtgccggacagctatacgggagatgtcattcttctcgacggaagccgcacgattctaagcctgccgcttgatgaaaacgacgaggaaaatccagagacggctgtaaccgcggagaacttggcgtacatgatttacacgtctggaacgaccggacagccgaagggtgtcatggtcgagcaccatgcgcttgtgaacctgtgcttctggcaccacgacgcgttcggtatgacagaggaggaccgcagtgcgaagtacgcaggctttggatttgacgcttccatttgggagatgttcccgacctggacgatcggcgctgagcttcacgtcattgatgaagcgatccgcctcgatatcgtccgcctgaacgattattttgaaacgaacggcgtaacgatcacgttcctgccgacacagcttgcggaacagttcatggagcttgagaacacatcacttcgcgtcctcttgaccggaggagacaagctgaagcgcgcagtgaaaaagccgtacacactcgtcaataactacgggccgacagaaaatacggtcgttgccacaagcgcagaaatccatccggaggaaggctcgctttccatcggaagggccattgccaatacgagagtatacattctcggagagggcaatcaggtacagccggaaggcgtagctggagagctttgcgtggcggggcgcggactggcacgcggctatctgaatcgagaagacgaaaccgcgaagcggtttgtcgctgatccgtttgtgccgggtgagcgcatgtaccgcaccggcgatttggtgaaatggacgggcggcggcatcgaatacatcggccggatcgaccagcaggtcaaggtccgcggctaccggatcgagctctcagaaattgaagtccagctcgcccagctttctgaggtgcaggatgcggcggtgacagctgtcaaggataaaggaggcaacacagcgatcgcggcgtatgtcacaccggaaacagctgacatagaagtactgaaatcagcactgaaggaaaccctgccggattacatgatcccggcgttctgggtgacgctgaacgagcttccggttacggcaaacggcaaagtggaccgcaaagccttgcctgacccggacatcgaagcgggaagcggagaatacaaagcgccgacgaccgacatggaagagctgcttgccggcatctggcaggacgtgcttggattgtctgaagtcggtgtcaccgacaatttcttctcgcttggcggagattccatcaaaggaattcaaatggcgagccgcttgaatcagcacggctggaagctggaaatgaaagatctcttccagcatccgacgatcgaggagctcacccagtacgtagagcgtgccgaaggcaaacaggcagaccaaggcccggtggagggcgaagtcatcctgacgccgatccagcgctggttctttgaaaagaacttcacgaacaagcaccactggaaccaatctgtgatgcttcacgccaagaagggctttgatcctgaacgggtggagaaaacattgcaggcgctgatcgagcatcatgacgcgctccgcatggtctatcgtgaggaaaacggggacatcgttcaggcgtatcaaccgatcagtgagagcaaggtcagcttcgaaatcgtggatctgtacggctccgatgaagagatgctgagaagccagattaaaattctcgcgaacaagctgcagagcagtctcgatctgcaaaacgggccgcttctaaaggcggagcaatatcgcacagaagctggagatcacctgctcattgctgtacatcatctggtggtcgacggtgtgtcatggcggattttgcttgaagactttgcttcaggctacatgcaggctgagaaagaagagagccttgtcttcccgcaaaaaacaaactccttcaaggattgggcggaagaactggcggcattcagccaatcagcgcatcttttacagcaggctgaatactggtcgcaaattgccgctgaacaggtttctcctttaccgaaggattgtgaaactgtgcagcggatcgtcaaggatacatcatccgtcctatgtgaattaacggaagaagacactaagcatcttttaacagatgttcatcagccatatggaactgaaatcaacgatattcttctcagtgcgcttggtttgacaatgaaagaatggacaaagggggccaaaattggcattaaccttgagggacacggccgggaggacatcatcccgaatgtgaatatctccagaacggtcggctggtttacggcacaataccctgttgtgctcgacatatctgaagcagatgcctcagctgtgatcaaaacagtcaaagaaaacctgcgccgcattccggacaaaggtgttggctacggcattcttcgttatttcacagaaacagcggaaacaaagggcttcacaccggagatcagcttcaactatttgggccaattcgacagtgaagtcaaaaccgatttctttgaaccgtctgctttcgatatggggcgccaagtaagcggagaatcagaggcgctgtacgctttaagcttcagcggcatgatcagaaacggcaggtttgtgctttcctgctcctacaatgagaaggagtttgaaagagctacagtcgaggagcaaatggaacggtttaaagaaaacctcctgatgctaatccgccattgcacggaaaaagaagacaaggaattcacaccaagcgactttagcgccgaagaccttgaaatggacgagatgggagatatctttgacatgcttgaggagaatttaaaataaaacgcaagggaattacagaaggcgggagcgaaacatatgagtcaatttagcaaggatcaggttcaagatatgtattacctatcgccgatgcaggaagggatgctttttcatgccatcctgaatcccggccaaagcttttaccttgaacaaatcacgatgaaagtaaaaggcagcttgaatatcaaatgtcttgaagaaagcatgaatgtgatcatggaccggtacgatgtatttcgtaccgtgttcattcacgaaaaagtaaaaagacctgtccaagtcgtattaaaaaaacggcagttccatatagaagaaatcgatctgacacacttaacgggcagcgagcaaacagccaaaatcaatgagtacaaagaacaggataagatcaggggttttgatttgacgcgggatattccgatgcgggcagccattttcaagaaagctgaagaaagctttgaatgggtgtggagctaccaccacattattttggacggatggtgcttcggcatcgtcgtacaggatctatttaaggtatacaatgctctgcgcgaacaaaagccgtacagccagccccccgtcaaaccgtataaagactacataaagtggcttgaaaagcaggataaacaagcatcactgcgttactggcgcgagtatttagaggactttgaaggacaaacgacgtttgcggagcaaagaaagaaacaaaaggacggctatgagccgaaagagctgctcttttcactgccggaggcggaaacaaaggcctttaccgagcttgcaaaatcgcagcataccactttaagtacggcgctgcaggcagtctggagcgtattgatcagccgctatcagcagtctggcgatttggccttcggtacagttgtttcagggcgtcccgcggaaatcaaaggcgttgaacatatggtcgggctgtttatcaacgttgtcccgagacgtgtgaagctgtctgagggtatcacatttaacggcttgctcaagcagctgcaggagcaatcgctgcagtctgagccgcatcaatatgtgccgctttatgacatccaaagccaggccgatcagccgaaactgattgaccacatcattgtttttgagaactatccgcttcaggatgcgaaaaatgaagaaagcagtaaaaacggctttgatatggtggatgttcatgtttttgagaagtcgaattatgatctcaacctgatggcttccccgggagatgagatgctgattaagcttgcctataatgagaatgtgtttgatgaggcgtttatcctgcgcttgaaatctcagcttctcacagcaattcagcagctcatccagaatccggatcagcctgtcagcacgatcaacctcgttgacgacagggagagagaatttttgctaaccggcttaaacccgccggctcaagctcatgaaacaaagcctctgacggattggttcaaggaagcagtgaacgtcaatccggatgcacctgcgcttacgtattccggccagaccctgtcttatcgcgaattagatgaggaagcgaaccgccttgcacgccggctgcaaaaacacggtgcgggcaaaggctctgttgtagcgctgtacacgaagcgctcacttgaattggtgatcggcattctcggtgtattaaaggcgggagcagcctatctgccggttgatccgaagctgccagaggaccgaatctcgtatatgctggctgacagtgcggcagcctgtcttctgacgcatcaggagatgaaagaacaagcggctgagctgccgtatacaggcacaacgctcttcattgatgatcaaacacggtttgaagaacaggcaagcgatcctgcaaccgcgattgatcctaatgatccggcatatatcatgtacacgtccggcacaaccggaaagccaaagggcaatatgaccactcatgccaatattcaaggtttggtcaagcatgtagactacatggcattttctgatcaggatacgttcttgtctgtttcgaattacgcctttgacgcatttacctttgatttctatgcttctatgctgaatgcggcacggctcattatcgcagatgaacatacgctgcttgatacagaacggctcacagatctgatcctgcaagagaatgtcaatgtcatgtttgcgacaaccgcactatttaatcttctcacagatgcgggagaggattggatgaaggggcttcgctgcgtgttattcggcggagagcgcgcgtctgtgcctcacgtcagaaaagcgctgcgggtcatggggccgggcaagctgattaactgctacgggccgactgagggaacagtgtttgcgacagctcacgtcgtgcatgatataccggattccatctcctcattgccgatcggaaagccgatcagcaatgccagtgtttatattctgaatgagcaaagccagctccagccattcggggcggtcggtgaactgtgcatcagcggaatgggcgtgtcaaaagggtatgtaaatcgtgctgacctcacgaaggaaaagtttattaacaacccgttcaagccgggagaaacgctttaccgcacaggggatttagcacgctggctgccggatggaacgattgaatacgccggccgtattgacgaccaggtcaaaatacgcggacaccggattgagcttgaagaaatcgaaaagcagctgcaggaatacccaggtgtgaaagatgcggtcgttgtggcggaccgccctgagtctggcgatgcatcaatcaatgcctaccttgtgaaccgaacgcagctttcagctgaagacgtgaaggcgcacctgaaaaaacagcttcctgcttacatggtgccgcaaacctttaccttcttggatgagcttcctttaacgacgaacgggaaagtcaataaacggctgctcccaaaacctgatcaggatcagctggcggaagaatggattggaccgcggaacgagatggaagaaacaatcgcacaaatatggtctgaggttctcggcagaaagcaaattggcattcatgacgatttctttgcgctcggagggcattccttgaaggccatgaccgccgcttcccgcatcaagaaagagctcgggattgatcttccagtaaagcttttgtttgaagcgccgacgattgccggcatttcagcgtatttgaaaaacgggggccctgatggcttgcaggatgtaacgataatgaatcaggatcaggagcagatcattttcgcattcccgccggtcttgggctatggccttatgtaccaaaatctatccagccgcttgccgtcatacaagctgtgcgcctttgattttattgaggaggaagaccggcttgaccgctatgcggatttgatccagaaactgcagccggaagggcctttaacattgtttggatattcagcgggatgcagcctggcgtttgaagctgcgaaaaagcttgaggaacaaggccgtattgttcagcggatcatcatggtggattcctataaaaaacaaggtgtcagtgatctggacggacgcacggttgaaagtgatgtcgaagcgttgatgaatgtcaatcgggacaatgaagcgctcaacagcgaagccgtcaaacaaggcctcaagcaaaaaacacatgccttttactcatactacgtcaacctgatcagcacaggccaggtgaaagcagatattgatctgttgacttccggcgctgattttgacatgccggaatggcttgcatcatgggaagaagctacaacaggtgtttaccgtgtgaaaagaggcttcggaacacacgcagaaatgctgcagggcgaaacgctagataggaatgccgggattttgctcgaatttcttaatacacaaaccgtaacggtttcataaatgaagtgatgaaaggaggagacagccaatgagccaactcttcaaatcatttgatgcgtcggaaaaaacacagctcatctgttttccgtttgccggcggctattcggcgtcgtttcgccctctccatgcttttttgcagggggagtgcgagatgctcgctgccgagccgccgggacacggcacgaatcaaacgtcagccattgaggatctcgaagagctgacggatttgtacaagcaagaactgaaccttcgccctgatcggccgtttgtgctgttcggacacagtatgggcggaatgatcaccttcaggctggcgcaaaagcttgagcgtgaaggcatctttccgcaggcggttattatttctgcaatccagccgcctcatattcagcggaagaaagtgtcccacctgcctgatgatcagtttctcgatcatattatccaattaggcggaatgcccgcagagcttgttgaaaataaggaggtcatgtcctttttcctgccttctttccgatcagattatcgggctcttgaacaatttgagctttacgatctggcccagatccagtcgcctgttcatgtctttaacgggcttgatgataaaaaatgcatacgagatgcggagggctggaagaagtgggcaaaagacatcacattccatcaatttgacggcgggcacatgttcctgctgtcacaaacggaagaagtcgcagaacggatttttgcgatcttgaatcagcatccgatcattcaaccgtgatcaaaagcggacagcttcggctgttccgcttttttttatgttgaatgccaatttttgcatggtataatagtcgaaatacccaaataaaggaaggtcgaaacatgcgcacgtctcccaggatgaaatggtttgtattgctgtttacgtttgttttcgccatcggaatgaactcattcagaaattcctttcaattttttatgctgccaatggcggatgccttccatgccgacaggtcgctgatttcggtttctgtcagcatttttatgatcacaaccggcatcgtccagttttttgtcggtttttttatcgaccgtttcagtgtcagaaaaattatggcgcttggagctgtctgcatcagcgcaagctttttggtgcttccttattcaccgaatgttcatgtgttttccgccatttacggtgtgcttggcggaatcggctattcctgcgcggtcggcgtgacgacccagtacttcatcagccgttggtttgacacacataaaggtctggcgcttgctattttgaccaatgccaactctgcgggcctgctgcttctctcgcccatttgggctgcggctccgtatcatgccggctggcagagcacctatacgattttgggaatcgtcatggcggctgttctgctgccgctcctcgtctttgggatgaagcacccgccgtatgcgcaagcggagtctgtgaaaaaatcttatgattggcgggggttttggaacgtgatgaagcaatcccgcctcattcatatcctgtacttcggcgtgtttacttgcggatttacaatgggaattattgatgctcacctcgtcccgatactgaaggatgcgcatgtctctcatgtcaacggaatgatggccgcgttcggggcatttatcatcattggcggattattggcgggctggctgtccgatctcctcggcagcagaagcgtcatgctatccatcttatttttcattcggctgctcagcctcatttgcctgctcattcccattctcggaattcatcacagcgacctttggtacttcgggtttatcctgttattcgggctcagttacacaggcgtgatcccgctgaccgcggcgtcaatttcggaaagccatcaaacaggattgatcggatcgctgttaggcatcaatttctttatccatcaggttgccggagctctcagcgtgtatgcgggcggtttgttttttgacatgactcatggttatttgctgattgtcgctgtgtgcatcgtgtttgtgggtttatcggctgtaatagagctggtgccgtttttagataaacaaaaggcaaaagaaacccaccaatcaatataaaaggatcagcactgtcaatgctgatcctttttaaatttgagtttttttgtttcggtatttttaaggataatctccttgaatctgttcatctccacttcggaatgaaaaaaatgttttgggatcgcaatatattggctgctggatgtattgatgcggaagatattcttatattcgaaaacagctgtgatttcattccaattgaaaatgaggtcatattttttagaacatatacgaattccttcttggttcagagtatatgttcttttagatttcatccgttcgttcttcttgtatgctctggaaaacttcacatatagaagcaggaggagcagcagtgtaaacagaactgacatcacgataatcaacatactgttcataaacaagttaagcgcgtcactgccataaacgatacggggccatccgttaatgaagttaactgcagcaaatatggcgcaaaacaatagaaagtaaaagcatgatatttttgcgatttgataaaaaaagatttctcttacatccttaaaagtgatttctcctggaagattgatattttcactagcatattgaatcatacggtaaacctacacctctaaccatgtttttcctttcagtctagcataatttttcatttttttgcaggcataccagggcgctttgtttttttctccagattgatattgctccccaccacgccaatcataatacaaacagccccggcaagatgataccaggccaggctttcgttgagaatcacaactcctgcaatcatcgtcacaatggtagatacatgattaaaagcgctcattttaaacgcctcaattcgcgacagcgtatagttagacagaaatgaagtgacaagtgaagacagcacgcccaaatacacaatggcgagaacgaagccgggctcccggaacggcagaaaataagtgccgactgttcccgccgctccgtgacgcacaagggcgatggcgttgaagacgacaaagccgatggttgacatgatgtaggtgagctcggtcagcttgaaccgctgcgtcatttttctggcagcagtattgtacatcgctgaagacaaagcggacaaaaggatcagcaaagacccttttaagctggctgattccacgtcaacgcctttcatcacaaaaataaacatgacgccggcaacggataaaactgtgaatcccttttgcgtccacgttgggcgttcctttaaaacataagcggcaaagaccatcgtgaaaatcggaatggctgcctgaataattcccgcttcagaggaggacgagtacacaaggccgaatgcctgaaagctgaaaaataacgcgggatacagcagggcgagcggcaaaatggcaatgacgtcctttacgcggattgatagctttacccagccgaataagatcggtacagtggccgcagcaaacgcaatggtgaaccgatgcgccaaaatatcaaacggctctgctgtttgcagtgcgattttcacgaatagaaaggataaaccgataatgaacgaatataaaatagccgctatataagcgggggcttgctgatgtttaaccataatgggaagtgctcctttacctgaattgcagcgccggtcgctccctttattgtatggccgcggtcagaacggtacaatgagaaaaacaatgaactgtaccggtacaaaacagggggagaaggcatggagaaatatatgagtctagtaacgaggatagaggagatgatgcaaagcaccgcctatcaagaaggagacaggcttccatctatccgtcagctgtccgcccgctaccaagtcagcaaaagcacagtgatccgcgcgctgcaggagctggaaaagcgccaccttatctattctgttccgaaaagcggctattatattgtgaaaaagacagggaaatcaaaaagcgggcagcctggccccatcgactttgccacatctgcgccggacccagatgtgtttccgtatcttgattttcagcactgtatcaacaaagcgattgatacatacaaaaacgatttgtttatttatgggacgccaaaggggcttccatcactcatccgcgtactccgaaagctcttggccactcaacaggtatttgcggatgaacggcatattttcattacatcaggtgtccagcaggcgttatccttgctttgtgccatgccgttcccaaatgggaaagagaagatcgccattgaacagccgggctaccatttgatggtcgaacagcttgagacgcttgggattcccgctatcggggtgaaacgaacggaagaagggcttgatatagccgaggttgagcggttatttcaaacagaatcgattaaatttttttatacgatgccgcgcttccataacccgcttggctgctcattgtcagagcgtgataaacaggagcttgtgagactggcagaagcgtatgatgtctatctcgttgaggatgattacctcggtgatctggaagaaaataaaaaggcagatccgctgtacgcatatgatctgtcctcacatgtcatctatttgaaaagcttctcaaaaatgatgttccccggccttcgcgtgggggcggctgttttgcccgaagcgctgactgacacgttctatgcgtacaaaaagctgaacgacatcgactgttcgatgatttctcaagcggcattggagatttacctgaaaagcggtatgtacggcaggcataaggagaaaatcagagattcttataaagagcggtcgctgaggctacatcaagccattcgaactcacaggcagctgggaagcggacgctttacgttctccagcgggcaggcaccctgtatgcacacccacctggtgcttcctcaggatctgcccgcctcaagagtgattcatagactgaaaaaacaaggggttctccttgaggcgatagaccgtcattatttatcagattatcagaaagaaaatctattaaaaatcaatatttccaatgtgaaaacggaagatattgagcacggtgtcaagctgttgatgagccatttataaaagctcttcgtacgagaccattgtgatatcctcggggaaatcagggtgtgcggcgcatacagccattttgtagccgggatcgacctcatacgttttgatatagcatggggaatggctgtccggaagctcaatggatacttgtccgtcctggtgcaggcgcactgaaaaggaatcaagcggaagcgataagcctttgccttcctgtttgataaagctttctttcattgaccatagatgataaaaatagtctgtctgctcgtccttgtcttttgctaaaaggtcgctgtactctgtttttgaaaagaagcgcttggcgatctcaaggctgatcggtttcgttttttcgatatctatgccgatcggctgtgaatcaaacgcgcaaatgacccagcgtccggagtgagaaatgttgaaatgagcgtcgggaagatcagggatgcacggcttcccgtattcctgtgtgctaaagcggatatcggatttgtccaactgatactgcctgcttatgactgagcgaacgagcacatctcccagcagggtgcggtgagcatcttctttatgataaaatctccggcatttctcccgtttttcaggtgatatgaaagacatgaaccgttcattttcttcctgtgaaagcgggcggtccatataaattccgtaaatcttcattctagatcctccgtctgcaaaagattgtcaaaaccatcctatcatacttccacaagactcatatagaggagaaaataaaaaaacaaagccaaggcggctttgttttagtgtacaggcggagatgctttcacagcggctgtccgccttgccacagcataattcagcagctggattgactggggcaatgaaaagcgcaaaataagtccggtgaggatggcggtcaaaatggtgccaaaaccgatcggtccgcccatgccccatgccgcaaacaaaatggttaattccatgccgttccgcacccattgcacattccagccggttttttctgtaatcagcatcatcagtgaatcacgcggccccgcgccaaggcctgctgatacataaacaccgacgccgtaaccaatcagcaccacgcctagagagaagacgatgatcgagcctgtgtaggtcgagggggcaggcagaatgaaattgaaaaaatctataaatacaccaatgagcaccatattcaggagggcaccaattttcggccaagctctcgtaaacaatgacgtgaatccgacgatgagcgctccaataatgatggaccactggccgacggtaagcccgaagtgctgaaacaggctgtaatgaaatgcatcccacggactaatgccgagtgcttttccttctatcgtcagggatacaccaaaagccaaaatgatcaaaccggcaaaataaaatgtccagcgcagaacaagttcttgcttcacgtgaggtcccttctttcgtaaaaatcagtcgattgtcattgtagcacatctgacagaagggcggaataggcgaaaggggctcaacaaaaaaacagggccgccgcgggcgccctgtttcagcgtgttggcaaacccttgcattcgttgtcaggcctgtgcttcggtgctcacgaatttaacattcgctgtgctccaatgctcgcccttcctagacttcaaaggttttcaatcacgctgaaaatcacaaaatcctaaaacgaaaatcgttttaggattttgtcaataatctgaaacagggcgctggcgccctgtttttcttattacagcgggttcaaaatccggttcaagaaccgctgtgtccgttcttcttttggtgcggagaaaatttgctccggcggtccttgctccacgataacgccgccgtcgatgaagatgacttcatccgcaacctcctgcgcgaacttgatttcgtgggtcacgacgaccatggtccagccttcattggccaagttcttgataaccttcagcacctctccgacaagctcgggatcaagcgctgaggtcggttcgtcaaacagcatgagctcaggctgaatcgccagtgcgcgggcgatgccgacgcgctgctgctggccgccggaaagctggaacggatataaatccattttgtccttcaatccgactttatcaagaagctgaatcgcttcttttctgacttcctctttgttccgtttttgcacctgaacagggccttccatcacgttttcgagggctgtgcggtgcgggaacaggtgatacgcctgaaacaccattccggattttcggcgaagctttaggatatccgcctgtttcacctttttggagaaatcgatggagaaatcatcaaatgcaagctctccgcgattcgggatctccagagcgttcaggcagcggagcagcgtcgttttccctgaacctgaaggcccaagtatggcgatgacttttcctttttcaatcttcatatctatcttttttaaaatttcattttcaccgaatgatttgtttaatcctttaacggtaagcatactcggaacctccttatttggccacgtagcggtcaagacgccgttcgatgacatgctggacgagtgagagcaggaagcagataatccaataaataaaggctgcttcaatatagatcactaaaatttgatcaagattccgcgcgccgatttcctgggcttttctgaacagctcagcgaccagaatttgagaggcgagggatgtatctttaatcaggctgataaaggtattggataatggcgggatcgacacacgaaacgcctgcggcaaaatgacgcggaacagcgttttttgatgtgtcatgccaattgtgtagccggcttcccattgccctttcggcacggataaaatagatgcccgaatgatttcagatgcataggcgccgacgtttaatgaaaaggcgataactgcgcttggaaatggatctaatgtgacgttaaaggccgggaacagatagaaaatgatgaacaattgaacgagaagaggagtgccgcgtattgcggatacgtatacgctgaacacccatctcaaaggtctcactttcgacattctggcaagcgccgtaatcagcgccaggatcattccgaatataaaggaaagaatcgtaaggggaatcgtatagtagattccccctgaaagtatcggccagaatgactgctgcaccagatcccacgggatcgccgtgccaagcgtcaatgccggcagattatttagaaacatcttcgccgaaccattttttagaaattttagaaagagtcccgtcctctttcatttcttttaatgctttgttgacttgatcaacaacctcgccgcttcctttacggaacgtgaaatatgttgactgaggatcacctgtttcaaacgcgattttcacgtttttattgccagatgtttttaagtagttcaatacggcaagcttatcgttgtatgtcatatcgacacggccttgctggatcatttgaagggcctgcgccatgccttcaacgccttctactttagcgccggcatttgtagctaatttgttgtagttgcttgtcagtgattgagctgacgtttttccttttacatctgcttcagacttaatatcgttgttgtcttttttcgttacgacaacggctcttgatgttgtgtatttatctgagaaatcatatttgtcttcacgatctgtttttccgacttggttggcaacaacgtcaaaccgtttggaattcaggccggcaaacatactgtcccactgtgtttccttaaagtcgactttaagcccgaggcgttttgcgacttctgtgataacttcgacatcatagccagtcagtttatcagtgtctttgtcgtggtaagtgaacggctcatatgttccttccgttccgactgtgagcacaccttttttcttaattgaagcccaaagatcgccatctttggcattatcttttgactgattgtcatttcctgctccgcaagctgcaagagctgcaatacttacgaccatgaataaagccaataatgcttttttcatcttattccccacttttctggttgattttattgaaataaaaaattagcttacaaatctaaaggataacttttttttagtatgagtcaagtatttggttttcataagacaaaatcttttaaaataaatccaaaaattgctgtgccggtttaggcaaataactgtccgttctccacatgacagccggtgtcataatgaagggattattttcgatatggacggtgtgaacgtgatttctcatatgaacgggaatcattgtgacgggcaaaatagacgcgccgaatccggatgacacgaggctgagcaaagttgcagagtcgtggcattcacaaacaatgcgcggctccaggttcaaacgatgaaattcattcatgacctgattatagacgccttttccgttgacaggccgcagcaggatcagcggaaatgaaggaatgtcctccatcttaatggtgtctccgcacggatatccggcttcatctgaaagcacgagcacacatggaatgtcatcaagctgcttgaattgtactgtgtcacttttgatcagtgttgtcgtgaccgccgcatcgatttgccggctttccagcagttccaacagtgtcgcgggctcattttcccaaatattaaaggtgagatgggggtatctctctttgatctgtgttactttttcaagcatcagagccgcgcaataaattgttgaccccacggcaagtgtgccggctacctcctccttcagctcctgtacctcaatgactgcatcttcaaacctatgcagaatctcttttgctctttttagaaaaacagctccttcatatgtaagagtcatttgttttttcttgttccggtcgaacagaacaacaccaagttcgtcctccagctgtttgagctgcctgcttaaaggcggctgcgccatgtgaagctttttggctgcggacgtaattttctgttcttgggcaatggtaatgaagtatcgaagctggcgaatatccaaaagaaagcgcccccttatcataccttttaggtattaattatagatttaatagatatttttcatatggatatatcaggagtatgattgaaatgaaagcagaattcaagcgtaaaggagggggcaaagtgaaactcgttgtcggaatgacaggggcaacaggggccattttcggggtcaggctgctgcagtggctgaaggccgccggagtggaaacccatctcgttgtgtctccttgggcaaacgtcacgatcaaacacgaaacaggctataccttacaagaagtagaacaactggccacatacacttactcacataaggatcaggcggcagccatttcaagcgggtcgtttgataccgatggaatgattgttgcgccgtgcagcatgaaatctctcgcaagcattcgcaccggaatggcggataatctgctgacacgtgcggcggatgtcatgctcaaggagagaaaaaaactcgtcctcttaacgagagagacgcctttgaaccaaattcatctcgaaaatatgctagcgcttacgaaaatgggtacaatcattcttcctccgatgccggcattttataatcagccgagcagcttagaggaaatggttgaccatattgtattcagaacgttggaccaattcggcattcggcttcctgaagcgaagcgctggaatgggattggaaaacaaaaaggaggagcttgatcatggcttatcaagatttcagagaatttctcgctgcccttgaaaaagaaggacagctgcttacagtgaatgaagaggtaaagccggaaccggatttaggggccgccgcacgggcagccagcaatcttggcgataaaagccctgcgctcttatttaacaacatttacggctatcataacgcgcgaattgcgatgaatgtcatcggctcttggccaaaccatgccatgatgctgggcatgccgaaagacacaccggtaaaagaacagttttttgaattcgcaaagcgttatgaccagtttccgatgccggtcaaacgtgaggaaacagcgccatttcatgaaaatgaaatcacagaagatatcaatttgttcgatatactgcctcttttcagaattaaccaaggtgatggaggctactatttagacaaagcgtgtgtcatttcccgtgatcttgaagaccctgacaacttcggcaaacaaaatgtcggcatttacagaatgcaggtcaaaggaaaagaccgtctcggcattcagcctgtcccgcagcacgatattgcaatccatctgcgccaagctgaagaacgcggcatcaatcttccggtcactattgcgctcggctgcgagccggtcattacaacggcggcatcgactccgcttctctatgatcaatcagaatacgaaatggcaggtgcgattcaaggcgaaccatatcgcatcgtcaaatcaaagctgtctgatctggatattccgtggggcgctgaagtggtgcttgaaggtgagattattgccggagagcgcgaatatgaagggccgttcggtgaattcacaggccattattccggcggacgcagcatgccgattatcaaaattaaacgcgtctatcacagaaacaatccgatctttgaacatttatacttaggcatgccttggacagaatgcgattacatgatcggcattaacacatgcgtgccgctttatcagcagttaaaagaagcgtatccgaacgaaattgtggcagtgaacgccatgtacacacacggtttaatcgcgattgtttccacaaaaacccgctatggcggatttgcgaaagcggtcggcatgcgcgcactcacaacgccgcacggactcggctactgcaaaatggtcattgtcgttgatgaggatgtcgatccattcaaccttccgcaggtcatgtgggcgctttcgaccaaaatgcatccgaaacacgatgcggtcatcattccggacttatctgtcctgccgcttgatccgggatccaatccatcaggaatcactcacaaaatgattcttgacgccactacaccggttgcgccggaaacaagaggccattattcacagccgcttgattctccgctaacaacgaaagaatgggaacaaaaactaatggacttaatgaataaataaggaaaggatgttcgaaatgcatacatgtcctcgatgcgactcaaaaaagggagaagtcatgagcaaatcgcctgtagaaggcgcatgggaagtttatcagtgccaaacatgcttttttacatggagatcctgtgaaccggaaagcattacgaatcccgaaaaatacaatccagcgtttaaaatagatccaaaggaaacagaaacagcaattgaagttccggcggtgccggaacgaaaggcttgatccgcgtgaacagtatgtcagaccgtctctttgagctgcttgacgggagatgcctgagtgagaagcagcatgaggccttcgttctgcaaacagtatcagaggatggctggccgcatgccgctatgatcagtgcaggtgaaattatcgcgctgagccgaactgatatccgaatcgctctgtggaaaaacacaatgacttcggccaacatccttcgcacaggaaaagcacagttcacggcatggtggaagggagcggcctattatgtaaagcttgaatgcgcgcctttaccgcctttgaaagatgccgaatatgaaagagaccgtttttcctgccgcatcgtttcagtgaaggaggacgttgcgaaatacgctgatttgacttctggtgtccgtatacagcttcacagccctgaagaggtgctgagcagatgggaaaagaccctggaagatttaaagcggtaatatcgatagcctgacgccatgcgtcaggctttttttatataatgaaaacaaagggggcgtgagaaatggaacgtgcggggatctgtcactcggacggctttgatttagcttatcgaattgagggcgagggcgcacccatccttgtgatcgggagtgcggtttactatccgcgccttttttcctcagatatcaaacagaaatatcaatgggtctttgtcgaccataggggatttgctaagcctaagcgggagcttcgtgcggaggattcggggcttgatgccgtcttggctgatatcgaaaggatgagagcatttcttcagacttgaggatgttactatcctgggacattccgggcacgcttttatggctttagagtattccaggacatattccaaacaagttcggaaggtggcgctcttcaatactgcgcctgataacagtgaagaaagacagcgaaaaagcgaatcatttttcatggaaacagccagtcttgagagaaagaaacgctttgaaaaagacatcgcgaatttgccgcaggacatcgaaaaagatcctgaaaggcgcttcgtgcacatgtgtatccgcgctgaagcgaaaagcttttatcaagagcggccgcatgctgctgccttatgggacggtgtattcacgaatatgccgatcatggatgaattatggggcaaaacatttgcccggcttgatcttattcagcggttagctgatgttcgtatgccggtgtatatcggattagggagatatgattatttggttgcgcctgttgcgctatgggatgctgttgacggtttatatccccatgtggataaggttatttttgaaaagagcggccatcagccgatgctggaagaaccggaagcctttgatcaaagcttcagcaaatggctggatcaataaaaaaacagcccgcagatcaaaatccgcgggctgtttctgattataagacccctttcatcgcgcgtttgataaccggcgagagcagcaggagaatgccgccaagaacgatagaaatcaaaccgatggtgccgaagtacattgtttcaggaattttatcaaacaatccggctacttgggcattgatcgcttgggctgctgcgttcgtcagaaaccacatactcattgtctgtgcagagaaggcagctggggccagtttcgttgtcacggataaaccgactggagacaggcacagctctccaagcacgacaagcaggaagctgagaacgagccaaagcgggcttacgagtgcttcttttccttgcatagcagggaataccataatgataaatgacaatccggctaaaataattccgattgagaatttaactggtgtagacggctggcgtttgccaagcttcatccagagccatgcgaatattggcgcaaaaatgacgacaaacaatggatttaatgattggaaccaagatgactgaagttcgaatccgcccaatgaaagttttatgcgttcatcagcgtataccgcaagaatggtcgctccctgttcctgaatggcccagaacatgacagcaccgataaacaaaggaacgtaagcggcaagacgggatttttctgttttgtccgcttttttgcttgtaaacatgatgatgaaataaatgacaggaatcaaaataccgagaatacttacaaggtcgataaaacgcttgatcgtcagcacgcctgtttgtacagagatcatcactgcgatcgccacgatgataacaccgattccggtgccaatcgcagattttttagacagcggattcggcacattggaacctgcaagcccgaggtttttctttcttgtcaaagcaaatacgataagtccgagaagcattccgaccgcggcagctccgaagccgagatgatagttgtacttctgtccgagtgttccgacaattaacggcgcaagtaaaccaccgaggttaatccccatgtagaaaatactgaaacctgagtcgcggcgcgggtcttctttcgtgtaaagatccccaaccacgcttgaaacgtttggttttaataagcctgttccgacaatgataagcaccatgctgatatagaatgcgatcgcgctgcccggataggcgagtgcaatgtggccgaacataatgaatatgccgccgtaaaacacggtgtttgcggtaccgaatacccggtcagcgagccatccgccaataatggtggacatgtatacgagtgatccgtaaatcgacataatggcaaccgcagtgcccttgtcaaagccgagccctccgtttaccgtctctgtatacaaatagtaaagtaagattgctctcattccatagtaagagaaacgctcccaaaattcggtgaaaaatagtgtaaatagtcctcgcgggtgaccaaagaaccctttttgcgggacgcttttaatgatactttcgttatcaatcgaagccatgtcagccaaaccctttctaaaaaaagtgtattataaaaatcatattcttatataatacttgtgtcaatataatttatactcatttcaaatagttccataatggaaaaattataaatacctaaaaatagtgattttctcctaatttttatactctttatcgtgagattttcttacacaactattcctttatatttttttaataaaattttagagaaatgtacaagcagatcgggcctttgtgagtaacatgatagtaatcatagagaaggaggctcgcaattggctgaattcatattaaatgcagcggatttcggtgttcctggagatggtaaaacggattcgacagaacggattaatcagtgcctcagtacagctgtttcgaaaggctatcatactgtctggtttccaaagggaacatatttaatagacgcaacgcttggcggagatcttaatcagaggtttcgaaacgcgggatcattgttcccggcaaccttgagattatgatggaccccgaatgtatcatgaaagtgataccgaatagttcgtggggttattccgcattttatgtaggcaagcaagagaatataactatttccggaggacaaattatcggcgaacgggatgagcatacgtatgtctcggcggggataaggtcaacccatgaatggggctttggcatatgtattgaaggatgctcgaatgttgtcattgatgatgtgaaaatttccgattttaccggcgatgggatcatagtcagcccaaggggattaaagaccaatcaagattatcgaacgtcagagcaaattatcatccgccgctgtgaggttcggcggtcgaggagaaataacatttccattaccggatgtgacatggtcacggtggaggaatgcttgattgaagatgccggaacggggaatggaacagccccgaaattcggaattgacattgaaggatatggcgaaggtgacgttgattatgaggaaccgattaatgtatcaattcgcaataaccactttgttggaaacgtttcaagttctgtgaccaattttaacgggtatggcattttaatagaaggaaatcactctgacaatacaatcagctacggatatgggacgcaaacagtgatcaagggaaatatactgaggcgccctgaagacgcggcggctgcgccaagagtcgggataaccggactcggtgtatcacaaggaaaagagaccagtgatgcagtgatcgctggcaacctcattaccggattttcaactggaattgatgtcaggggaaagagcgttcttgtgacgaacaacaaaatcagcaactttgaaaacacagggatattggtttatcagtcttccgacgtaaaggtagacggaaaccaaattcaaaacggactgtctgaaacaaggcgcagcatcggtcttcgcgcagtgctgtcagatgacatcgcttttctgaataactgtctcattcaagtcgttgacggtgtgaacgtttccggcggaaatatgatcattaaagataatctcctgagaaaattcagccggggcatttggattgctcaagggaacgcggtgattgaagggaatatactgaatcctgacgcgtttgaagcagtgccggaatcatattctgtttccgtcacaaacaatgccggcgccatcatcaaaaacaatacatttaaagagttcaaaaattaccccatttattgctccacaagtgcgaaaacctcaattatcggcaaccacttagagagatctccgcttttggtcaccatctatatcagcgccggtgtgcatgagatttttgataataccatttcagtcaacagaacagccgggaatccgattgtgatttatatcaatggctctgcaggctctatcgtctcaggaaacaccatcaataacctctccgcgggcactgcgacagctattcaaacaaacacgtcaaccaactccaaaatcatcggcaaccgcatttttaaagggacaatcaacaaacacagcagtgatgcaatagacggcaatattatcgtctgaaaaaagcgcccctctaggggttcttttttttcgatttatagatcacgtacatttctctcacaagtactaaaacaaaaaataaaattacaacccattccgcaaatgttgtcatcttaaagctggacatattgttataaacggcttttgttaaactgaacccttgaagcatgtccatcaatacagaaatagctaataaacaaattaatatgactccagtcacgcccaatatcttcatgcttcatcatcctccgcttttagtgtctatcgttggcggagaagttataccgcatctaaccctaatgcataatctcaattttaaaaggaagaatatgagaaaacgacaaggaaaggtatttgtgtatgcctttattttctaagcgaaagaacaataccgattcaaaagacaagcagaatacagacgaaaggaaccaggaacagcagcaagaaaaagaaaggccggttctcatttctccaagtttggcaaagaatatagcggaaacgaaaaaggaagtcggaagcagctctgacgtcatcattcgcgagattaaaatcggggagcaggatcatgtccacctagctgttatctatattgctgggctggtcgataataacacgatccatgagtcgttaattgacccattggtacaggatgagtctatccagaatactcatgcgatccagcaaattcttgaaaaaacgctcccgctgggcggggtgaaagcggaaaagagctgggacaagcttttttccgagttaatgctcggcaatgcgctcatttttgctgatggccatgatgaagctttgatttgcagcactcaagggggagagcagcgctccatccaagagccgagcacccaggtgtcattccgcggtccgcgccaagggtttacagagtctctgcaaaccaatatttccatgatccggcgatacattaaaaatccgaatttatgggttgaaaaaatgaaaaaaggttctgttacgaatacggatatcgctctcatgtacattcaaggaatatgcgatgaaaaggtgctgaaggaagtgaagcagcgcctggaaaaaatagatattgacagtattttggaatctggatatattgagcagctgattgaagatgaaacctttacgacgtttccgactatgtatcatacagaacgccctgatgtagtagcgggtaatctgttagaaggaagattcgcgattattgtggacggaacaccgtttgtgcttattgccccggccttatttgtccagttttttcagtctgttgaggattattattcgcgttttgacattgcgacaagcataagaattcttcgtgttttagtctttttcatttcgcttgtggctccggctgtatacgtggcagccacgacgtttcatcaagaaatgataccgactcagctgttagtggtcattgcggcccagcgggaaattgtcccgtttccggctgttgtggaggcgctgacgatggaggttgcttttgagattctgagggaagcgggattcaggctgccccgggttgttggctcggcagtgtcaatcgtaggcgcgctcgtaatcggccaggctgccgtacaggctggtatcgtctctccggcaatggtgattatcgtggcactcaccgcgattgcgagcttcgcaacaccggcgtttgcaatggcgatttcagcccggcttattcggtttatttttattattgcctcagctgttatgggtttttacgggctgattttagggatcattatgatgtttgtccacttatgcagtcttcgttcattcggcgttccatatatgtcgccgcttgcacccttttcttcacaaggcgtaaaggacgcgcttttccgggttccgtggtgggccgatgaaaaaaggccggaatcggtcagcaaggaagataaggtgcggcaggggcaagatcaacgcccagagccggccgcttcacgaggaatggtgaacaaagatttggaagaaggggatcagaatggtacgtaaatgtctattagccgttctcatgcttttgagcgccattgtgctgcccggctgctgggataagagggagctgacggatcttgcgattatctcggcgattggcatcgatcggacaaacgacagcaactacgtgctgcatcttcaaattatcaatccaggaaatgttgccggcggccttcagggaggcggtgctggagacaggccgcctgtatatgtctattcgattgaaggtaacaatataacggaagcactcagaaaagcctccatgaaggtatcacggcggctttattttgcccataccaatctagtcgtgatcaatgaaaagctggcaaaagaagaaggtttggattttgtattagataatcttgaccgggacacagaattcaggacaacagcaaccttcgtcgttgcccataaaacaaaagcagaaaatattgtgaaaatcctgacgccaattgataaaattccatcaaataaagtcaataaaaccttggatttcacggaggcgcaatacgggcgggtggtcaaaaccaatattcaggacgttttgaaaacacttgccgccaacactatggcaccggtcatccccggatatatgatgattggtgacgataaaaaaggagtcagcatggaaaacacgcaggcgactgacccgaaagccattcttcaggcagatggtctggcggtttttgataaggcaggatatttaaagtattggctggaagatgatgaaagcgtgggggcagtctggcttatgaataagatccagcatacgtttattaatgctgactggggcaagacgaaggatgcggtcagcttgcaggttacccatcaagatacaaagctggtaccgaaaatgcggaacggacgtccgtacatccatgtgaaagtgtcggttgaaggtattattgatgctgtcaaataccctttccaattgtctgatcccaaggtgctggccgctattgaaaaagcgctcaacaaagagcttgaaaaggaaatcagccatactgtgaaaaagattaagaagaataaaatagattttatcggttttggtgacacgatatatagaaagtatccggagcagtgggagaaaatgaaggacacatgggacaaagaatatttgcccgaactgcccatcgatgtgaaggccgagacgtatatcagaaggacgggattgcgaaacgatccgatcaaacaccagtttaaagatgattaggtctgaagaaaggggaagtgacagatggaaaaagccagaataagcataaggcagctgtttgtcatgattatcatttttgaactgggcagctccttattgattacaccgggatcaatggcgggcagggatgcttggatagcagttttattaggctgtgcgatcggactgtttcttttctatttgtatcaaggcatttatcaatgttatccgaattcttctccgaaagaatatatggatgatatgctgggaaccaagctgagctggctgttttcatttctctatatattgtactttgcctatattgccgcaagggtgctgcgtgactttggagaaatgctgctgacgtttgcttatcatgatacacctatcattattgtaaatgctttattaatggtagtaagcatatatgccgtaagaaaaggaattgaagtactcgcacgcgctgccgaacttcttttcggggtcatgtatttactgggcgcgatcgggctcgtgctgattattgtctcaggcactatagacccgcacaatttaaagccggttttggcaaacggtatttctcctatccttcactctgttttcacgcagaccatgtacgtcccatttggtgaagtcgttttatttgtgatgattttccctaacctgaatgacagaaaagatgtgaaaaaaatggggatgattgccatggctattagcggattggttgtggcgctcaccgtggcgattaatatcatcgtgcttgatgttgatcttacactcagatcccagttcccgcttttaagtacgattcagacaatcaaggtcgaagaatttttagaccggctcgatgtcttttttatgctggcgctgatcatcggcggcttctttaaggtcagcctctacttatatgccactgtggttgggacatctacgctctttaaggaaaagaatccctctcaattggcttatccgatgggattgggcatcttaatcctttctttaacgatcgcaactaacttttcagagcacttgaacgaaggcttgaacgtggtgccgctgtatattcatttgccttttcaattattgtttccgctctttctgtttattgtggctgtttggaaaaagaaacgaagagagaagtcaaaagggacaggagcaaaggaatgataaaaagagcggggggatgcagccgccgctctttttatgttcacttctatataaaagggggatatagggtgcgcccctgtctgcactggcagaggcgcgttttgttataccactgcgacgttttccttcacagtaaagcttcctcttgaaagtctgatattgatgtctgacacttttgcaatttgttcatcgtgcgtcaccataatgacgcatttattttccttgtgcgccagatcctgaaagagccgtacgatctcttttgatgtgtcctcatcaaggtttccggtcggttcatcggctacgataagatccgtgtcacagcagaaagcccttgtaattgatacccgctgctgctgtccgccgctcagtgtgagcactttttgccgggcttgtttttcgttgatgccaaccttctgcagcatgtcaagcgcatatgattctttgttcttttctttagatcctgtgatttccatagcggttgtgacgttctgcaaagccgtcatatacgggagcaggttgtacgcctgaaagacgattgatacatattgatttctgaaattggttaagccgattttagaaaccgcttttccgtcgtaaaggatgtttccttcttttggtgcgtcaagtccgcctgccagagacaggaaagtggttttccccgtccctgatgtgccgacgattgtgtagaattttcctttttgaaagctgatgttaatatcctgaaacaatggctggcttttgtctttataccagtagccgacttgttgaaattctaataagctcataggttccgcctctttctattcctgttttgtcaatatcgttttcggatgaagccgcagtactgaaattgacggcagcaatgttgcaatgattgcgattaggatgccgatcccgcccagaataagcatgtcgttcatagaaaccgcgacgttcagtgaatcgataacgtccacgtttgatgaactgtggccgaacattccgccgcccatgccgccaccgccgccgggcatttgtccgcttgcggtttgcgttgaatcggttgatgaactgatttgctgggataaaagctgatttccaagctgatttgcgacgagatttcccgtcacagatgcaaggccgatagcgataacggccacaatcagaatctcagtcaagaactgtccaatcaatttccatcgtttttcaccgatggccattaacacgcccatttcgtatttgcgctccctgattgacatcatgacaatcaggccaagaatgacggcgcctgccactgatacaagatacaccacgtttttagagaaagaagccacattttcaatcggtccgaccatttgctggtaaagctgatcgtttgtattcagtgtgtacgtatcgaagtctattgatgttttcttcgctgcttttacgaaagcatccatatttttcgcgtcgtccatatagtaaacagctgagtcaatcgtatttttatagtcgtcgcctttcagcgccgctgttgctgtgtaaggcgtataaagcttgttataagggtttaagaaagagaaattttgggcttggtcatcgcctgaagatgttgttttataaataccgacgatcttcagctttaccgtcgtatcttcatctgttgctgattcaattgtgatcgaatcgccaacgctcaaatcattttcttccgctaaagtttcgttgatcactgttacttttttgccgacatctgattttgtaatcgcgcgtccgtctgtgatttttgaatctccgtcagagaaatcatcgactaacgctgtgctgatgacaccttcaatcgaaagatcggcttgaaccatttgcggtccgccttgtccgccgccttggctgtttttagcgtttgagcttgaactgctggagctggaatcacttgaactagagctttcaatcgcatcaaagtttcccgcgttggctgaagctgatgtggtgtaattgtagctcttcacatgatcaagcgctgcaagcttattcgcatcagacactttgatcggtgtggattcgaagctgcgtttttcaccgctgtcctgctgtttttccatttgcttttggcggtcaacctgtagtgtcacgcttccgccgagttcctgtctggccagttcgcttgatttttgtgctgccgactggatggtgaggcctgatagaacaaagacacatatgactgtaaacacaaataattgcaataatgtttttccctttttagccttcatattccaaaaggcccgtttgataaagttcatttatgttcctccgtataggtactttgattgataaggccgcctctggggcgggcttgcttgttgataaattaatagtagtccaaaggtatgaaaaaaatatgaacaatctatttctagttgatgaaataaaaactaacaattgtgaaacgcaaaaccttctgtttaaaatggtgctattatataaaaaagcatcaaaacaatcggaggatataatgaaaatattaatgatagaagataatgttagtgtatgtacgatgacggagatgttcttttttaaagaaggttttgaagcggaattcgttcatgacgggttagaagggtaccagcgttttacggaagaaaattgggatctgatcattttggatatcatgcttccatctatggacggcgtgaccatctgcagaaaaataagagagacaagcacggtgccgattatcatgctgactgccaaagacactgaatcagatcaggtcatcggctttgagatgggggcggacgattatgtcacaaagccgttcagcccgctgacattggttgcccgcatcaaagccgtcatcagaagatataaggcgacaggcaaagcggttattgatgaagatatgatcgaaacggaatgctttaccattaataagaagacgagagaagtattattaaacggagagcctgtagaaaatctcacgccgaaggaattcgatctgctttattaccttgtccaaaatccgcggcaggtgttctcaagagaacagctgcttgagcaggtatggggctatcaattttatggagatgagcgaacagttgacgttcatatcaaacggctgcggaaaaagcttgccagcgaagacaagcctttcttgtatactgtgtggggagtagggtataaatttgatgaagattaaatatttatatcagctgctgctaagccacatcagcattttgattttagcgtttgtcattatcatttctctgttttcccactttgtgaaagaatttgcctatcaaaacaaagtagaggaattgacgtcatatgcggtgcagatcgcaaatgaattccaagccggccaggtggacatgcgcaggctctatccttatcaggacattttaagcacaagaaagacgcaatttatcatctttaatgaagagcagcagccttattttcttcctgaaggctttcatcacccaccaagggaacagctgaagaaatcagaatggaataagctgaaaaaagggcagactgtcatgatcagggcagatggccgttttgatgatgaagtgtcccttgtggcgcagcctatatttgttcagaacgaatttaaaggcgccgttctgctgatttctccgatcagcggtgttgaacagatggtcaatcaggtcaacctctatatgttttacgctgtgatcagcacgcttgtgattacgattcttgtgagctggcttctgtccaaattccatgtcaagcggattcaaaagctgagagaagcgacagataaagtggcttccggcgattatgacatccatttggaaaacagctacggggacgaaatcggcgtactggcgtctgactttaatatcatggcgaaaaaactaaagcagtcaagggatgaaatcaatcgccttgagaagcggagaaggcagtttatcgctgacgtgtcacatgaattaaaaacaccgctgacgacgatcaacggtttggttgaagggctgaacagccatacgattcctgaggataagaaggataaatgcttctcgctgatcagtgaggaaacgaagcgcatgctgcggctcgtaaaagaaaatctggattatgaaaaaatcagatcccagcaaattaccttgaacaagctaaacgttcctctgatcgaggtgtttgaaatcgtgaaagagcacttgcagcagcaggcggaagaaaaacaaaacaagctgatgatccaggtagaggatcacgtcatcgtacatgccgattatgaccggttcattcaaattctcgtcaacattacgaaaaacagcatccaatttacgaaaaacggtgacatttggctgcgcggaatggaaggttataaagagacgattattgaaattgaagacacgggtatcggcattccaaaagaggatattgagcatatttgggagcgattctataaagcagatatttcaagaacgaacacggcatacggtgaatacggactcggtctctcgatcgtcaagcagcttgttgaaatgcaccagggcacagtagaaatcaagagtgaagaagggaaaggcacaaagttcatcatccgccttcctttaacggcaaaacagcaatagcatacagggcggcggcatcatctgatggagccgccttttttgcacaccgcttcggtttattgcgtgctcccgaaaacaaagattgcgtgtttttcgggttgggacggtctataaacatgataaaatatgacataaacagtttttgatgggagagggtgaaggaatgaagagcggggtaattccttcttcagcggtcggtcaaaaaattaacgagtggtacagatatatccggacattcagcgtgccggatgccgaagtgttaaaagctgaaatccagcaggaactgaaacacatgcagcatgattccaacttgctgctttattattcactaatggaattccggcaccagcttatgctggattatcttgagccgttagagaaattaaatatcgaagaccagccaagcctgtctgaattatcaagaaacattgacagcaaccaggcagatctcaaagggctgctcgactattacgtgaatttttttcgcgggatgtatgagtttgataagcgggaatttatttctgccattacatactataaacaggcggagaaaaagctctcctttgtcgcagaccatattgaacgggctgaattctattttaaaatcgcggaagcttattattatatgaagcaaacgtatttttcattgattaatataaaaaacgcctatgaaatttacgtggagcaggaaacctataatgtgagaatcattcaatgccatttcgtgttcggggtcaacctgatggatgaaagaaatttcgaacaagccgcacgccatttcaaattggcgctcaatatggcccaagcggaacaaaaagcccagctggtcggaagagcatactacaatctcggattatgctattacaatcaagaccttctaggccctgccattgattactttgaaaaagcggtctccacgtttgaaagcagcaggatcatcaattctctcccgcaagcctattttttaatcaccctgatttattataaacagggaaaacatgataaagcttcggaatatcacaagcggggctatgaatatgctaaagaaacagacgatgcagactatgccgtaaaattcgagtttttgcaatccctatatcaggatcagcccaatgaagaaggaatcgaacgatgtttccaatacttaaaaaataaaaatatgtacgctgatatagaggatttagccctagaagtagcaaaatattactatgaacagaaatggtttaaactgtctgcttcctactttctacaagttgaagaggcaagaaaacaaatacaaaggagtgaaggtttgtatgaaattgaaatctaagttgtttgttatttgtttggccgcagccgcgatttttacagcggctggcgtttctgctaatgcggaagcactcgactttcatgtgacagaaagaggaatgacgtaagaacaagccccttctcatttgcgagaaggggtttttcttttcaaaaacaccgcaagacatagtcttgcggtgccgccttcatggagattacgtttatttagtagcctcctacaaatgcagttcccacaatgatcaagaggataaataacacaacaatcaaagcgaaagaagttccgtaacctgacattttgtgcacctccttgcgagattgcttcagcaaatgctgcaaaaccgtggcggacagggtcccgcagagacggtcagcagcttagtagccgccaacaaacgcagtccctacgataattaaaagaataaacaatacaacgattaaagcgaaagaactgatgccgccgtaaccgccgccgttagagtatcctgacataaggtttcacctccctatgaaggatactataagatatgctgaaccgatccatttggcagggataatagtggacaagagaaaaaatgaacaattcggctatatgaaggtgatataaaaaatagcgggcgctgccgcccgctatttatgtacgattaagagattaatacgcccgcgaaaaattcctggtataacgcttgaacggcttttctttcttcggcttcttttacgccaaacatcatgctcacttcagaagacccctgattgatcatttcgatattcacctgtgcctctgataatgctttggcggctcttgccgttgtaccgacattgtggcgcatcgcttcccctacaaccataatcagggcgagatgatgctccacgatgacttcatcggcatgcaaatcctcttcgatccgtttgatgacgctgcgttcagtggcggcattcatttgcccctgccgtaaaatgatcgtcatgtcatcgattcccgagggaacatgctcatacgtcaaaccatgctcctccaggatttgaagggctctgcggccaaaaccgatttctctgttcatgagatatttgctgatataaatgctgcaaaaaccggtgtcgctggcaatgccgacgacaggcccgtttgtgttatcccgcttgctgacgacgcgggtgccttcggctgaggggttgttcgtatttttgatctgaacaggaatccccgctctgaatgccggaatgagcgcttcatcatgaaacactgaaaaacccgcgtaggacagctcccgcatctctctatatgtcagctcgctgatttcctttggattctcaacgaaggacggattgacagaatacacagcgtctacgtctgtaaagttttcgtacaaatcggcttgtagtccgttggcaagaatcgaaccggtaatatcagaaccgctccgtgagaatgtgatcacatcgccatccttgctgaatccgaaaaaaccgggaaaaatgatgagtccgtcacgttcccgaagacgatagaggttttgataggattcaggaagaacttgcgcgttgccgggttcatttgtcacaaagaggccggcatccttcgggtttacatactccgctttgacgcctttatagcggaaataagcggcgatcagcttggcattgttatcctctccgctggccttgactgcgtcaaggtattgttcgggattgcttttatctccttctaaaagcgtaaacagatcatctctgattttttcgataatgccttgccccagctgaagctcagtggcgatgagagcgtaccgttccacaaccgcttccgccagttcaggtgcgctgcctgatgccaaatattgttctgcacatgcgattaagagatcagtcactttcgtatcctcggcatagcgttttcccggagctgaaacgactacagctttccgtgccgggtctgaggtaacgatgtgaaacaccttgtcaagctgggcgcctgaagcaagtgagctgcctccgaatttaacgaccttcatgtttacatctcctaatgtttaaaattttcacacaaatttagtatttattatctctctttcagtactgtaaatcaaggggaatttctttctggagagaacatttgtatttttcacaaggaataatgtcaggtttgctgaccgtatgcctgcgttataaagataaatatggtaaacagcctaacgttttgggatggaaaatggttagaatgattagtaaaatggataaatgactaggttaatatttttaaagaatattgactaaccctagaaaaatggtaatatgtaaatgataatgataatcaattactatatggccatattgttttgagtccttgcggagtaggagatacgttctttttgctgtaaggatgtaaggaggcagcatgaagctacgttacttatttattctacttatcatattagcagtcacatctgtatttatcggtgtagaagatctgtcgccgcttgatctcttcgatttaagcaaacaagaggcgtcaacgctgtttgcaagccgtttgccgcgattgatcagcattgtcatcgcgggattaagcatgagcatctgcggtttgattatgcagcagattagcagaaataaattcgtgtcaccgacgacggcgggcacgatggattgggcgaggctcggcattttaatttccttgctgctgtttacatccgccagtcctttaatcaaaatgctggtcgcgtttgtctttgcccttgcaggaaattttctgtttatgaaaatccttgaaagaatcaagtttaacgacaccatctttattccgcttgtcggtttaatgctcgggaatatcgtcagttcaatcgcgacatttatcgcatataaatatgacttgatccagaatgtgtcatcatggctgcagggagacttctctttagtcgtgaaaggaagatacgagcttctttatctgagtattccgctcgtcatcattgcctatgtgtatgcggataaattcacattggccggtatgggtgaaagcttttctgtcaacctcggcctcaagtacaaacgggttgtgaacatcgggctcattatcgtgtccctgatcacgtctcttgtcattttgactgtcggtatgctgccgtttctcggtttaatcatcccgaatattgtatcgatttacagaggagacaatctgaagagcagcctgccgcatactgcgctgttaggagcggtgtttgtgctgttttgcgatatactgggcagaatcattatcttcccttatgaaatctcgattggcctgatggtcggaatcatcggcagcggcattttcctgtttatgctgttaaggagaaaagcctatgcgtaaccagatgaaaatagctttgctcgttggtttagccattgtatgtattggcttgtttttgttttatgacttaggcaattgggattacaccctgccgagacgaatcaaaaaggtcgcagccattgtgctgactgggggagcgattgcgttttcgaccatgatctttcaaacgattacgaacaaccgcatcctgacgccgagcattttgggccttgattctctctacatgctgattcagactggcattatctttttgttcggttctgcgaatatggtcatcatgaataaaaacatcaactttatcatctctgttctgctgatgatactgttttctcttgttttgtatcagatcatgttcaagggtgaggggagaaatatctttttccttctgcttatcggaatcgtgtttggcacgctgttcagcagcctgtcttcttttatgcagatgctgattgatccgaacgagttccaagttgtgcaggacaagatgtttgccagctttaacaatatcaatacggatttgttatggctcgcgttcatcatcttcctgctgacaggcgtttatgtctggcgttttacaaaatttttcgatgtgctgtcgctcggacgcgagcacgccgtgaatttgggcattgactacgacaaagtggtgaagcagatgctgatcgtggttgcgattttggtttctgtttcaacagcgctagtcgggccgattatgtttttaggccttctggtcgtcaacctggcgagagaattcctgaaaacatataagcattcatacttaatcgcaggctccgttttcatcagcatcattgcgctggtcggagggcagtttgtggttgagaaagtgtttaccttctcaacgacgctgagcgtcattattaattttgccggcgggatttattttatctacttgctgttaaaggagaataaatcatggtagaggtcagaaatgtaagcaaacaatatggcgggaaagttgttcttgaagagacgtcagtcacgattcaaaagggcaaaatcacctcgtttatcggtcctaacggcgccggcaaaagtacgctgctgtctatcatgagccgcctgatcaaaaaggattccggcgagatttacgtagacggacaagagattggagcatgtgacagcaaagagcttgccaagaaaatgagcattttgaagcaggcgaaccaaatcaatatcaggctcacgatcaaagacctcgttagttttggcaggtttccgtactcacagggccggctgacagaggaagactgggttcatatcaaccaggcgctcagctatatgaagctggaagacattcaagacaaatacttggatcagctgagcggcggacagtgccaaagggcatttatcgccatggtcattgcccaggacacagattatatttttctggatgagccgctgaacaatctggatatgaaacactcagttgaaattatgaaactgctgaaacggctggtagaggagcttggaaaaacgatcgtcatcgttattcacgatatcaattttgcttcagtctattctgaccatatcgtcgctttgaaaaacggccgaatcgtaaaagaaggaccacctgaagaaatgatagaaacatcagtgcttgaggaaatctacgatatgaccatcccgattcagacgattgataatcaaagaataggtgtctatttttcttaatatatagaagaggtgaagagcatgaaaaagttcgcattactattcatcgctttggtgacggcagttgtgatttctgcatgcggaaaccaaagtacaagcagcaaaggttctgattctaaggaagaacaaatcacggtgaaacaccagctggacaaaaacggaacaaaagtaccgaagagccctaaaaaagttgtcgtatttgactttggaagcttagatacattagataaacttggacttgatgataaagtagcgggactgccgaaacaagcccttcctaaatatctgtccaaattcaaggatgacaaatatgctgacgtcggaagcttaaaagagccagacttcgagaaagtggcagatttagatcctgacttgatcattatctcaggaagacaatctgagtcttacaaagaattctctgaaattgcgccgacaatttaccttggcgtagacacagcgaagtatatggaatcatttaagtctgacgcagaaacaatcggtaagatcttcgataaagaagatgaagtgaaggatgaactcgcaaaaatcgatcattcaatcgcagatgtaaagaaaacggctgaaaagcttaacaaaaacggtctcgtcatcatggcgaacgacgggaagatcagcgcattcggtcctaaatcaagatacggcctgatccatgacgtgttcggcgtcacaccggctgataaaaacatcaaagcgtctactcacggacaaagcgtttcttacgagtacatttcaaaaacaaacccggattacctgtttgtcattgaccgcggtacagcgatcggtgaaacatcatctactaaacaagtcgttgaaaatgattatgtgaagaatgtaaacgcagtgaaaaatgatcatgtcgtctaccttgattctgctacttggtacttatcaggaggcggtcttgagtctatggcacaaatgatcaaagaagtgaaagacggtttagaaaagtaaaaccaaaaagagcctccgctaaatagcggggctctttttttgttaatcagcgtgccggctgctgttcggcagggcgctgaggtttctttaatgtgaatgagagaaggaagccgacaagtgcaatgacggcagccactataaaagcggcgttcatgccgtgcagggcggcgtgcttcacatttgtcgtgcctgcatgtgcggcctggttgctcatcacggaaaccaatagtgcggttccgatcgagccgccgacttggcgaatcgtgttgttcatcgcagttccgtgcggaatcaagtggcgcggcagcgcgttgattccggctgttgtcactggcatcatgatcatggcggtacctaagagacgaacggtgtataaaacgacaatccaagcgagtgacgtatggtcagtcagctgcataaacggcagagatgtcaggaagatgatgcagaaaccggcaatcgccagccctcttccgccgacacggtcaaaaattctgccgataatcggcgacataaagcccatcacaacggctcccggaaggagcataagccctgtatcaaaagctgtgacgtctctgacattttgtgtataaagcggcaggatggtttccgtaccgatcaataatgcaaagacgagggttcccagcagtgttgttaagctgaaaacgccaaacgtgaagacgcggaattccagcatcggtttttcaagcttcatttgtcttgtgataaacaagagcagcgcgatgacacccaccagcagtgaaatcaagacggttgaactggaccagccataagagccgacgcttgagaagccgtacagaaggccgccgaacccaaatgttgaaaggatgactgataaaatatcaatctgtgtttttcttaaagtcgtcacgtttttcatcaggatgctggcaagaatcaaatcaatcacagcaaacggaagaataatataaaacaatgatctccaagagaaagcttcgacagcccatccggaaagagtcggtccgatcgcaggcgcgaatgagatgaccaatccgaccatacccatagcctggccgcgtttttcaatcggaaagattgtcaggaatacagtctgcatgagcggcatcataatgccggctccagccgcttgaatgatacgcgctgtcagcagaaccgggaagttcggcgcgaacgctccgacgactgttccggcagtgaaaatgctcattgctgtgatgagcagcgcccggcttgtgaatttctcaattaaaaacgcggtaatcggaattaaaatcccgttagttaacataaatgatgtggtcagccattgtgcttggttggcatcgacattgaaatccctcatgatatggggaagtgcggtaatcaacaatgtctggttcaaaatcgccacaaacgctccggctaacaaaatgccgacaatgacagaacggttaaaaggtttttgttcaatacttttgttcaatacatatcccttcttttctctaagtaattaacagtgtttttaacatggaaacgggctgtgttaaaacaccggtttgttccagatagccaatcagtgatttgagtaaaaaagcgcggggttcttccttcttcgcttcttcctccagcatggcagctgcggatgtcagttcatctacgtcatagtccgcggcggacagggaagagatgcctttatgtaattccttcaggctttccgataataggactgatttatcctttggcttgtaggaggatgctgaatgaatataaagctcgatggcttcgggcggaagaagagactggcgggtttccctgtttttgataatctgattgagggtgctgatgataaactctgcgatcgggtcaagctcaagcggtttttcctcgattttgatcagcattaaaaactcacgcatcatgccgtgaagaatgataaccaaatcccacacaaacgggagaatggtttctccatacgcctggatcagcgaatcgcggtgccagcagataatcgtcgatctggtctgatggatatgctgtttgacccggtcattgtgcagcttggggtttccgtaggtcagcatattgaaaaactgctgattccgcctgaagccctccagttccattttgaccttttgcgtcaaacgctcctccggtgtaagtgcggtattttcctgaagtcttgaggccgcggccaccatttgcttctggttaaatgacagcagctccaaaagcagatcttctttagattggaacagcttatatatcgaagcttttgacatcttacattcttctgcgatcgcctgcatggaaaccgacgtaaaatccttttccgaaaaaagctttcgcgcggctaacaagatatctgtttttttatcaagcatctcatggcttccttctttcttgaacattagaaaacccattggttcacagaaaaccaatgagtaactatgaaaaaaattttaccaaataaacaaaatagaagtcaatggattttaaccgggtaaatgaaaggcctgccggaaaatccgacaggccgaataagagcttatttttcaactttaaatccttgtttttcaagcatttcacggatgtgcggatagtacaggcgctcatagtaggaagcgatgctctgtgaccaatttcttgtttcttttccgtttgtccgtttattcatgtattcagacatctgttcgtcgtatgcctgaatgtgagacgtcagctcatcctgattcaaataagtttcctgatgattgacagcttcctgcggcaagcgcggttttttcgctgaacggtcggcaggatgcccaatgacaaggccggataaagggaacacgtattttggaagctcaagcagttcgatcagctcttgagggtttccgcgaaccgcaccgatcggaactgtgccaagtccgagtgactcagccgctgctgttgctgtgccgagggcaataccagcgtctactgcgccgacaagaacagattccaatccatttgtgatttccattttgaaatcatgcagatcttcaagcgcaattttggcccggttgaaatctgcgcagaacagcaggaaaacaggagcttgatcgatccatggctggccgcctgccagttcggagattttctttttgcgctctttatcctggactgtgatcacagtcacttgctgtccgttgatagaagaaggggctgattgcaccgcttcaatgatttggtccaattgctcctgagctacaggctcatctgtgtagctgcgaatcgagcggtggtctgttaaagatttaatcacttcattcatatgagacacccttcctttactcgctaagctctgtgcggacaacatcaagaggagcgctcagcagttcttttccttttgcgacaaacccttggaaatgtgcagtttcgttatggaatttcattgccgcttcatctttccatttttcaagcatgacaaatgtattttcttcgcctactttttcgaataggtcgtattgcgcgttgccttcctcagctcttgaatgctgaacaagtgattgagcctcgctcaaaaattcctcgcgtttttctggttttactttgatgtaagcttgtaatacgatcatgtaaatctcctccgtcgttatgcgaatttattgttcgaatttcatcgaactaaatgtaacatgtattctaaatgaggtaaaggaaaaacccttaaatagtaaaattgtcattctaattgttgtgtgatacatttgtgtcatgaacattccaaaccatccagaaacagaaacattgcagctgacaaaggttcttcatgcacttagtgatccgcttcgtttagagctcgtcaagcaattagctgaagcaaaagaaaaaacgtgcagcacctgtgcagatgtgcaggttgccaaatcgactttgtcgcatcattttaaagttttgagagaatcaggcatcgctcaagttcggatagaaggaaagcgccggtattattcgcttcgcgctgaagaccttgaaaaggcatttccgggcctgcttgaagccgtgctgaatgtagaccaggaccgctggtgaatcaatcccctgtaacggggatttttttatgtccgtaaacagctttgaaaagccgctgcacaccctcctgaatatcttcttccttcagccgtgcaaagccgataatgagagcaggcctgcccgtttgccgcttgttttccttcaagttaaatcggctcattccgaatatttcaagctgcagcccggcagcatgtgacaggatgtcttgttcggtgcgcctggtatcaaattcggtaacaaaatgcagccccgcatttgccccttttacggtaacctctccgctgaactctgcttctaaagcggtgatcaggcgttctctcttttctttataatgctgcatcattttttttatatgcttctgatattcaccagactcgataaattcctgcagggtgagctgtgtaagtgatgagcaagtctgcagatcatagccccgctgtttgtatgccctcaacagctcaggcggcaacaccatatagctgatccgcaagccggggagaagggactttgaaaaggttcccatatagatgacattttgaaaacggtcgaggctttgcagcgccggaatactgtctacatcatatgtgaattcactatcataatcgtcctcaatgatatatcggcgcggctcctcggctgcccagttcagcagctgaattcttctggatacaggcataatcgttccggacggaaactgatgcgacggggtggtcaccagcacatctggctgctgtctggtgatttcagcaatcgacatgcccttttcatccagcatgatcgtcttgacttgttttccggcattcttcaaaagctgatacatgcgcctgtagccaggctcctccatcgcatacacggcttcattgggtaaaagctcagtcaacagctgcatgagcacctgtgtgcctgcccctatgatcatttgttccggcctgcattttacacccctcgtcagggaaatgagcctcgtaatggccgctctcacttcatatatcccttgcggatgtgacatatcgccgagcgtgcggtatgagcgggaggccgctttttgctcgcagcggaaccagcttttgatcggaaaatggtctgtatcggaactcatgtgtgaaaacgatatccaatcgctctggtcgatgtgaatctcttttagatcatccggcagtgcaaatggagggtgctcctcggcggaaaacatgtctagttcctccacgaagaaaccctttcgttcaatggcgtacaaatacccctcagccagcagctgctgataggctgaattcactgaatttacgctgaccttgagattttcagccagctcccgcttggagggaaccttcgagtgcggcagcagattgcggctgaggatttcttttttcagcttttgataaatttgctgatagatataatcggcttgttctgaacgatcgagtgtaatcgtgatatccatttgtattttctccttctgataccatcaaaaagttataattggtacttttcatcataccaaagagaagtcagaatgataagaaaataccgacagggggatattcacatgagtcaaacaacagcaagcatcacaactgcacaatggcagcaaaaacgggatcaatttgtgtcaaaaggtgtgagcaacggcaaccgcagtctggcggtcaaaggagaaggggccgagctgtacgatctggacggccggagatttattgattttgcaggcgccatcggcacgttaaatgtcggacattcgcatccgaaggtggttgaggctgtgaagcggcaggcagaggagctgattcatcctggctttaatgtcatgatgtacccgacttatatcgagttagccgaaaaactgtgcggcattgcaccgggcagccatgagaaaaaagcgatttttcttaactcaggggcagaagcggtcgaaaacgctgtgaaaatcgccagaaagtatacaaagcgccaaggcgttgtctcgtttacacgcgggtttcacgggcgcacgaatatgacgatgagcatgacaagcaaggtaaaaccttataaattcggtttcgggccttttgcgccagaggtttatcaagcgccgttcccttattattatcagaagccggccggcatgagtgatgaaagctatgacgatatggtcattcaagcattcaatgatttctttatcgcttcagtggcgcctgaaacggtggcgtgtgtcgtgatggagccggtgcagggagaaggcgggtttattattccttcgaaacggttcgtacagcacgtcgcttcattctgcaaagaacacggcattgtttttgttgctgatgaaatccaaaccggctttgccagaactggcacttatttcgcaattgagcactttgatgtagtgcccgatctgatcacggtttctaaatcgcttgcggcaggcctgccattaagcggtgtgatcgggcgtgcggaaatgcttgatgcggcagcgccaggggagctgggcggcacgtatgccggcagcccgctcggctgcgcggcggctttggcagtcttggatattatcgaagaagaaggactgaatgagcgatctgaagaaattggcaaaatcattgaagacaaggcgtatgagtggaaacaagaattcccgttcatcggtgacatccgcagactcggggcgatggccgcaatcgaaatcgtcaaggatccagacacgcgtgagcctgataaagcaaaagcagcagcgatcgcggcctatgcgaatcaaaacggattacttttgctgacagcgggaattaacggtaatatcatccgctttttgacaccgctcgtcatttcagacagccttttaaatgaagggctcagcatcttggaggctggcctgcgagcttaatcattggaaagaaaacggctgggtctgctatcattttaagtaatcatgaaaagaaaggaatgttcaatatgccagatcaattaacggtctacaacccggctacgggcgaggagatcaaaacgattcctcagcaatcagccacagaggtagaagaagccattgaacgttcacatcaagcgtttaaaacgtggtctaaaacatcagcgaacgaaagagcgtctcttttgaaaaaatggtatgaactgattgttgaacataaagaagagcttgcagatttaattacgaaggaaaacggaaaaccctatcaggaagcagtcggcgaggtactatacggcgcaggctatatcgaatggttcgcagaggaagcgaagcgtgtgtacggaagaacggtcccggccccgacaactggtaaacgaattgttgtcacacgccagccggtcggccccgttgctgctatcacgccctggaatttcccgaatgcgatgattacacgcaaagcggcgcctgctcttgccgccggctgtacatttatcatcaagccggcgccggacacaccgctgtctgcttatgaactggcgcgcctagcatatgaagcgggcattccgaaggatgttcttcaggttgtgatcggcgatggagaagaaatcggaaatgtgttcacaagcagtccgaaaatccgcaaaatcacgttcacaggctcaacacctgtagggaaaatccttatgaaaaacagcgcggacaccgtaaagcacgtctcaatggagctcggcggacacgccccgctgatcgtagatgaagatgcggacattgaccttgccgttgaacaggcgatggcgtccaaataccgaaacgccggccaaacctgcgtatgtgccaaccgcctgatcgttcatgaatccattaaagatgaatttgctgcgaaactgagcgagcaagtgtctaagctgaaagtcggaaatggacttgaggaaggcgtcaatgtcggcccgattatcaacaaacgaggcttcgaaaaaatcgtcagccaaatagatgatgcggttgaaaaaggcgcgaaagttattgctgggggcacatatgaccgaaacgatgacaaagggtgctactttgtgaatccgacagtgctcaccgatgtcgatacgtccatgaacatcatgcatgaggaaacattcggcccggtcgccccgatcgtcacgttttctgatattgatgaagcgattcagcttgccaacgatacaccgtatggcttggctgcttacttcttcacagaaaactaccgccgcggcatctatatttccgagaatctagagtatggcattatcggctggaatgacggcggaccgtcagctgttcaagcgccattcggcggaatgaaagaaagcggcatcggccgtgaaggcggttcagaaggtatcgagccgtaccttgaaacaaaatatttgtccatcggtttataaaagaatgcacgctcctgagagctgccggattttccggcagctctttttgtgttccggcgaataatcacaacaattccagccaaaataacagcaaatacattttgaaagaaggttccccaacaatggatttattattggctcttctcccggctttgttttgggggagcattgttctcttcaatgtgaaattaggcggcgggccgtacagccagacactgggaacgacgatcggggcgctcattgtttctatcgttatttacttttttgttcagcccgttctgtcccttcgcatttttattgttggaatcgtatccggcttattttggtcacttggacaggccaaccagctgaaaagcattcaattgatgggcgtgtcgaaaacaatgccgatttccacaggaatgcagctcgtttccacctcgctgttcggtgtgatcgtgttccgcgaatggtcaacaccgattgcgattacgcttggcgttctcgctttgatctttatcattgtgggaatcattctcacgtccttggaagataagaatgataaaaaagagggcgagccaagcaatttgaaaaagggcattttgattctccttgtttcgactcttggttatttggtttatgtagtcgtggctagattattcaatgtgtccggctggtccgcgctgctgccacaggcaattggcatggtggtcgggggggtagttttaacctataggcacaaaccctttaacaagtatgcgatcagaaatattctcccagggttaatctgggcaggcggaaatatgtttttgtttatttctcagccgcgagtcggcgttgcaacgagcttttccctttcacaaatgggaattgtcatttctacgctcggtggcattttcatcctgcgtgaaaagaaaacgaaacgccagcttatagcaattgcgatcgggattatcctgattattgccgccgccgtattcttaggaatcgccaaaacaaattcataacaaatggaggaggatgtatatgtatccggatttaaaaggaaaagtcgtcgctattacaggagctgcttcagggctcggaaaggcaatggccattcgtttcggcaaggagcaggcaaaagtggtcattaactattatagtaataagcaagatccgaacgaggtaaaagaagaggtcatcaaggcgggcggtgaagctgttgtcgtccaaggagatgttacgaaagaggaagatgtaaaaaatatcgtgcaaacggcaatcaaggagttcggcacactcgatattatgattaataatgccggtcttgaaaatcctgtgccgtctcacgaaatgccgctcaaggattgggataaagtcatcggcacgaacttaacaggtgcctttttaggaagccgtgaagcgattaaatatttcgtagaaaacgatatcaagggaaatgtcatcaacatgtccagcgtgcatgaaaggattccgtggccgttatttgtccactatgcagctagtaaaggcggaattaagctgatgtctgaaacgttggctttggaatacgcgccgaagggcattcgcgtcaacaatatcgggccaggtgcgatcaacacgccaatcaatgctgaaaaattcgctgaccctaaacagaaagcagatgtagaaagcatgatcccgatgggctatatcggcgaacctgaggaaattgccgcagtggcagtgtggcttgcttcgaaggaatccagctatgttacaggcatcacgttgtttgcggacggcggaatgacgaaatatcctgctttccaggcaggccgcggttaaacataaaaagcgacccagacatgacatctggatcgctttctttattaggcacgctttttctttacaagtgctgctacagataaaataatggcagccgcagacagcacaatcgctgtaatgtctagagctgaagaacctgagttttcggaatcgtcttctgttttcgtggccccgtgctcatctgtcacttgttttgcagacgtgatgtttgtaatggaatgaggtgtatcggcatcctcgtcacctgtccactcaacaatgctgccgtctttgtaatattggtatgcgtcccaagcagcttcctccgctttgtcagggtttttggcaacaaaggtaaactgctggaactgtccttcctgaatgcctccgtcagtcgcctcccatgtcacggacactgatttgtcatcatgtttttgagtggaaaccttccagcccggaattggctcatattgctggaattcaacatccttcggcattttgaggacaaccttcgttgtcggcagatttttctctgaaggaaccttcattgtatacgtttcccaagagcctgcagcagactcagccggttttacagaaacatgcgcgctggcaggggccgtaaagaataagagggagccgacaatagccggacatagtgtcaatgcgatttttttcaacaacgtaaacactccttaattggtctttgtaaacatgatattgatttcgttaaagtcgccggtcaggccgtggactttgatcttccagtttcctttttcattaatcgacaggttttgatcctggaagacgccttttgttttttcttttaatgtaaaggtgcttttgttttcgctgcctgacagacctgttttataaacggttaacgtgatttgctggatgtttttcacgggatctccgttatggtcggtgacacgcagctcaaaaacattttttccgggctggtttgggctgatgctgagagaaacgctttgtccgttctcaattgctttggtttggtagaacggttccggcgctggctcaggcgggcttggcaggcttgtaaacacggccgctgtgatcaatacagcgatgccgattgcccactccgctttcaacgttcggctgattcctgtgcggcgctgctttctggtaagcagaaaatgaattgcgcctaagaccagcatgaaaacaaacagcccgcttttcactaaaagagcttggccatacgctgtatggaacagtgaatccattgaacgaatgatgaaaaatccattgagcaagcctgaaaacaaaatgacgccgactgcagtgagcgcccatggagagaaccgtctgaccgtctcccacgcgagcgttttgtcaggctgcctccattcttttgagagcagcaaaacgagtgccgctattccgccgacccagatggaagcggaagttaaatgaaggaaatccatcaaaatgccgaccgttttttcttcaacgacagcagcatgcccggtaaacgccttggcaagcaggagaccgaaaaagaaaatgagcggcgctgtccaatagccaaaggatgaaaagcggtttttccgtatcgcaggaattacagacagtgcgagcagcacgaacagcgcggcctgtatgatccaaatggagccgcctgctgtctcaaacagtgtttctctgatgtagcccggctggaatgcgctgccccagccgccgcctgcgttcgcttttgtctgaatcggaagctgaagcaaaagcgccagccccaatgctgcgatcgagccggtcaggatacgtctcgtccgtttgacgagctgttctgatttccctttataccagaaaagatggaagaaaaccgttccgataaacagagataaggctgtatacagaatcgcgcgatctgctgctgttcccggattcagagctgaatcggctgctttttggctgctgaatccgccatccgctttcccgatactgaatggaatgacgccggaaacaggatgcccgtccgcggatacggcattccattccgctctgtacacatctttaggcagattcttcttcagcttcactgtcatgatgtgatgattatcttttttgatttcagtcttgtccgtatccacacggtcgccgtttgaattatagactttaatgtaatgaaacccttcttcaaccggttcattaaattcgatttccacctgtgcaggggcgctttttaattcgctgttttccccaggtgaagatttgacaatataggcgtgagcaaagcttgttttcggcaggaaaacaagaaaaagcagaaggatgatccaccatctgtttcgcttcatcactcagacaccaccttccgctgtatgtgttgtgttatttcttggtgcaggtgcagcgtttctttcggtcttgaagcatgtcttccagcgcttggtcgaaagtgcggacggctccgccgaatcctttttgaaatcgttcggcatggtcaagtgtcgcaaacggaatggcctgcggctggcagcagtgcaggtttaattcagcatttacgacgaaataagccgaaccggcactgacggttgtctgtaacagaaaatctctgcaaatcaagtgtgaaacctcttccgttttatccgcgtaacgcaaaaacgcgcaatgtgcgcagcatagctgttcaatgtcttggtttaccgtaatcagctgaaccgaatgagcttgattgacgggcttcaagcaatagctgcacatatgatccgtttgaggtgttcgggcggggagcgtgatgccgccggccgttttaatgacctcatttgactgaaccagctgattgacatctctgtataccgtcatttccgaaacgccaaaccttgcgctgatgtcagaaattctgagcgcgccttcttctttcagccacttcagtatgtgttgttgtctattaatcggaagcattcatacaccctcttcattaagatctatttaagcgtagaggattttagagacagagacaagtaagctgatgataaaaaatgtgaaaatatgttgaacagcaacaaaacgaaacagaagggactctggtataatagacatatggaatagaaagtgaggaataccctatgaaagaaacaccatgcccgaactgcggcaaacctttgacaggcgacatggtcagatcatcaaatgtgccttgtcaatttcgctgcggacactgccgggaacggctttatgaatataaagtatcagctccgattatgctggtatcattagcggccatcgtgctgctcatttatcttttgctgctcctccgcaatgcggcaggttcaatgctgccggctgtacagcacgtgccaatggctgtttttgcgcttgtgtgcgcctatcccgtttttattgtgagtgagcgaatgatcgcaaagtacgtgattcaaaacggcaacattatttatagaggaaagagaaaaggctcctgaaaccaggagcctttttatttttaaaaaattgtcacagtcatgtgccaaagtcctctttactttcaattgtatagggactgtaagcgttttaacatagagacaaagggaagcatcattctctgaacatatttttgcaccttacagcgacaaacaaaacagggagggtttatatatgcagcagcaagaacagcagcaaggcggcatgaaagtgaaagtgcagcgctttgggagttatttgagcggaatgatcatgccgaatatcggcgcgttcatcgcgtggggtatcattaccgcgctgtttattccggcaggatggtttccgaatgaacagttgaacacgctggtcagcccgatgattacgtatttattgccgcttttgatagcgtatacaggcggaaaaatgatctacgaccaccgcggcggagttgtcggagcgacagcggcaattggggtgattgtcggatcggatattccaatgtttttaggcgcaatgattatgggtccgcttggcggatacctcattaaacagactgataaattattcaaggataaagtcaaacaaggctttgaaatgctgatcaacaactttacggcagggattgtcggcgcggctttaacgattctcgcgttttacgccatcggcccggttgtcctgacgctaaataaattgctggcggctggtgtggaagtcattgtacacgcgaatttactgccgatagccagtgtttttgtagaaccggcgaaagtgttgttcctcaacaacgctattaaccacggaatcttaagcccgatcggaatcgagcaagcatcccaaacaggaaaatcaattctgtttttagtagaagcaaaccctggaccggggctcggcattttgctggcgtacatgttctttggcaaaggatcttcaaaatcaacggctcccggtgcggcgatcatccatttcttcggcgggattcacgagatttacttcccgtacattctgatgaaaccggccctgattctcgcagccattgccggcggagcaagcggactcttaacgtttacgatctttaatgccggacttgtcgcggcagcgtcaccgggaagcattattgcattgatggcaatgacgccaagaggaggctatttcggcgtattggcgggcgtgttggtcgctgcagctgtatcgttcatcgtttcagcagtgatcctgaaatcctcaaaagcaagtgaagaagacctggctgccgcaacagaaaaaatgcagtccatgaaggggaagaaaagccaagcagcagctgctttagaggcggaacaagccaaagcagaagaagcgtctgagctgtctcctgaaagcgtgaacaaaattatctttgcgtgtgatgcgggaatgggatcaagtgccatgggggcatccatcttaagaaacaaagtgaaaaaagcggagcttgacatcagtgtgaccaacacggccattaacaatctgccaagcgatgcggatattgtcatcacccacaaagatttaacagaccgcgcgaaagcaaagctgccgaacgcgacgcacatatcagtggataacttcttaaacagcccgaaatacgacgagctgattgaaaagctgaaaaagtaatcttatagaaagagagtgatactcatgcaagtactcgcaaaggaaaatattaaactcaatcaaacggtatcatcaaaagaagaggccatcaaattggcaggccagacgctgattgacaacggctacgtgacagaggattacattagcaaaatgtttgaacgtgaagaaacgtcttctacgtttatggggaatttcattgccattccacacggcacagaagaagcgaaaagcgaggtgcttcactctggaatttcaatcatacaaattccagagggcgttgagtacggagaaggcaacacggcaaaagtggtattcggcattgcgggtaaaaataatgagcatttagacattttgtctaacatcgccattatctgttcagaagaagaaaacattgaacgcctgatctccgctaaaagcgaagaagatttgatcgccattttcaacgaggtgaactgacatgatcgccttacatttcggtgcgggaaatatcgggagaggatttatcggcgcgctgcttcaccactccggctatgatgtggtgtttgcggatgtaaacgacacgatggtcagcctcctcaacgaaaaaaaagaatacacagtggaactggcggaagagggacgttcatcggagatcattggcccggtgagcgctattaacagcggcagtcagaccgaggagctgtaccggctgatgaatgaggcggcgctcatcacaacagctgtcggcccgaacgtgctgaaactgattgctccgtctatcgcagaaggtttaagacggagaaacgctggaaacacactgaatatcattgcctgcgaaaatatgattggcggaagcagcttcttaaagaaagagatatacagccatttaacggaagcagagcagaaatccgtcagtgaaacggtaggttttccgaattctgccgttgaccggatcgtcccgattcagcatcatgaagccccgctgaaagtatcggttgaaccatttttcgaatgggtcattgatgaatcaggctttaaagggaaaacaccagtcataaacggcgcactgtttgttgatgatttaacgccgtacatcgaacggaagctgtttacggtcaataccggacacgcggtcacagcgtatgtcggctatcagcgcggactcaaaacggtcaaagaagcaattgatcatccggaaatccgccgtgttgttcattcggcgctgcttgaaactggtgactatctcgtcaaatcgtatggctttaagcaaactgaacacgaacaatatatcaaaaaaatcatcggtcgctttgaaaatcctttcatttcggacgatgtgacccgcgtagcgaggtcacctctcagaaaactgggagaaaatgatagacttgtaggcccggcaaagaaaataaaagaaccgaatgcactggcggaaggaattgccgcagccctgcgcttcgatttcaccggtgaccctgaagcggttgaactgcaagcgctgatcgaagaaaaaggatacagcggcgtacttcaagaggtgtgcggcattcagtcccatgaaccgttgcacgccatcattttaaagaaactaaatcaataaccgaccacccgtgacacaatgtcacgggctttttttactatctcgcaatctagtataatagaaagcgcttacgataacaggggaaggagaatgacgatgaaacaatttgagattgcggcaataccgggagatggagtaggaaaagaggttgtagcggctgctgagaaagtgcttcatacagcggctgaggtacacggaggtttgtcattctcattcacagcttttccatggagctgtgattattacttggagcacggcaaaatgatgcccgaagatggaatacatacgcttactcaatttgaagcggtttttttgggagctgtcggaaatccgaagctggttcccgatcatatatcgttatggggactgctgctgaaaatccggagggagcttgagctttccattaatatgagacccgccaaacaaatggcgggcattacgtcaccgcttctgcatccaaatgattttgacttcgtggtgattcgcgagaacagtgaaggtgaatacagtgaagtcggcgggcgcattcacagaggcgatgatgaaatcgccatccagaatgcggtgtttacgagaaaagcgacagaacgtgtcatgcgctttgccttcgaattggcgaaaaaacggcgcagccatgtgacaagcgccacaaagtctaacggaatttatcacgcgatgccgttttgggatgaagtctttcagcagacagccgctgactatagcggaatcgaaacatcatctcagcatattgatgcgctggccgctttttttgtgacgcgtccggaaacgtttgatgtcattgtggcgagcaacttgttcggtgatattttaaccgacatcagctcaagcctgatgggaagcatcggcattgcgccttctgcgaacatcaatccatccggcaaatatccgtccatgtttgaaccggttcacggctcagctcctgacattgccggacagggccttgccaatccgatcggccagatttggacagcgaagctgatgctcgaccacttcggagaggaagaattgggggcgaaaattctggatgtaatggagcaagtgactgccgacggcatcaaaacacgcgacattgggggacaaagcacaacggctgaggtcactgatgaaatctgttcgcgcttaagaaagctctgatgaatcaggccggggcagatggctgccccggcctgtccatttccttacgaaaatttccacgaaagtctaaccaagcagttccaaatgctgtataataatttggaattcttaggaaagcatcgggtgaaggaagttgaatgcaaaaacaatcacgttaaagaaaaaaataaaaatcaaaacgatcgttgtactcagtattattatgatcacagctctcatttttacgatcagattggtgttttacaagccttttcttattgaaggatcatcaatggccccaacgcttaaagactcagaaagaattctggttgataaagcagtcaaatggactggcgggtttcacagaggcgacatcatagtcattcatgacaaaaagagcggccgctcatttgtcaaacgtttaatcggtttgcctggtgacagcattaaaatgaaaaatgatcagctatacataaatgataaaaaggtggaagaaccatacttaaaggaatataaacaggaggtcaaagagtcgggtgtaaccttaacaggtgacttcgaagttgaggttccttccggtaaatattttgtgatgggagataaccgtctcaattcactggatagcagaaacggaatgggcatgccttctgaagacgatatcatcggtactgaatctctcgtcttttatccattcggtgagatgagacaggcaaaataaaacgcaatgcaacaaagaacatggaacgtacggaaccaaaacacgcgataataaagcactgtaagcgtttaaaaaatttctgatgaaacggggcggagccgtttttccgccccgttttttatgatagaaagcgttttgaagaaaagggccctgttgaaataaacagaatcaggattggcgaagccgtgaagcgcatcgaattggtaaatctcaagatgggtatgctgtttttcccgcagttttttgataagaagcgctacgtcaaacgacggctcataattagggaaaaacaataggaccgggcaggctggcacgtgatgaagagagtcgcgtatccgggaaccgtaataacaaaccgatccgctcacctcaggcatactgctgcatttccatgcgatagtagcccccacgctgaatccaatcacaaagatgtgccgtccggcgttttgtctgatcacattctggatgatggtttctcccgttttcagccgttcgtgttttgtaaattgttcgtatgccgtttttttttcttgcagtgtgtagacttcatcctcgccgagcaggttgggcgtcaacacatcatatccagccattttgatcagccggcccatctttttcatatggctgtttacaccgtatatttcgtgtacgagaatgacaagcggttttggggacataacggcctccttttgtgttttttccattatatcctatcgtttcactttaggctgagatataatggtcaaaaaaaggagatataaaatgaactcattatctttgcctcaccgctatccatttttgtttattgatggcgtgacggatagcgagcccggcaaacatgcggcagcttataagctgattagtgagaacgactggtttatcactgatacgcaaacagaaatgccgttttcacttgtgattgaagcgcttgcgcaaaccgcggcttttacaggaattacagatgagaacagcttgggattattgtcttcggtgaagaaagcggaaaagctgggagaagctgtgcctggtgaccggcttgatcttacgtttgaagtcacgcgcaatcggcgcgggtttgtgttcggacatgccaaggcatcagttggagagcagcctgttgctgaagctgaaatcggcatctatattgaaaaatgaaaaaaacccttcacaacattttgtgaggggttctattttgtgtcgtaatcccgttcgctttgagagttatctctttgctggcgtttgtgtttttcatcattcatattttccttcagctcttcattaggaatcggatcggttaagtcgttgtgctcggggttttcatttggtttgttttgctgttttctttctgtcatgtttgatcacctcaccgtttgttttcctcttatccgttctcctcaaacataggaaatcgcttttttgtcccgctgggtataatgtattagaatagagagaagcacaacaaaaagataaagagaggtacatatatgtctgttcaaagagaagatgtagatatcaagctgatcgcaattgatatggatggtacactgctgaacgatgagcagctgatctcggatgaaaaccgcaaagccattcgtgaagcggaggataaaggtgtgtatgtggtgatcagcacgggccggacgctgatgacgtgccgggagctggcggaatcgctaaagctgtcatcctttctaatcacggcaaacggcagtgaaatttgggattcgaattttaatttggtggaacggaagctgcttcatacggaccatattcaaatgatgtgggatttgcggaataagcacaacactaatttctgggcttctacggtgaataaagtatggagaggcgagtttccggaaaacataacggatcatgaatggctcaaattcggctttgacattgaggatgacgatatccgaaacgaagtgcttgaggagctgagaaaaaacaaagagctcgaaatcacaaattcaagtccgacaaacattgaagtcaacgcgcttggcatcaacaaagctgcagcccttgccaaggttacggaaaaactcggctttacaatggagaatgtgatggcgatgggcgacagccttaatgacattgcgatgatcaaagaagcgggtcttggcgtcgcaatgggcaatgcgcaagacatcgtaaaagaaacggctgattatatcacggatacaaatattgaggatggtgtcgctaaagcgattcgccattgggtactataaaaaaagagagtcctaagatggactctcttttttagtttggcaggttttattctgggaccatggtaggttttctgacaaaagtatttcacaaactgatatgattcacttataatgaaataaagttcaaaaattcggaatagtcgttccgaatttcgggacaataaatgacataaagcatatcgtttgctttggcaggagggattctgtgtttcagattgatttaaactgtgatttaggagaaagcttcggagcctacaagataggccttgaccaagatattttagagtatgtgacatcagcgaatatcgcatgcggatttcatgcaggagatcctagtgttatgcgaaaaaccgtcgcgcttgcagcagaaagaggcgtgaaaatgggtgcgcatccgggcttgccggatttactcggttttgggcgccgcaatatggcgatttctcctgaggaagcgtatgatcttgtcgtttatcaaattggcgcgctctctggctttctaaaagcagagggacttcacatgcagcacgtcaagccgcatggcgctttatacaatatggcggcagtcgatcaaaaactgtcggatgctatcgcgaaagctgtctataaggttgatcccggcctgattcttttcggtcttgctgagagcgagcttgtaaaagcgggagaacggatcggacttcagaccgcaaatgaagtgttcgccgacagaacataccaatcggacggcacgctgacaccgcgctcccagccggacgcactcattgaaagtgatgatgccgccgtcacccaggtcatcaaaatggtgaaagaaggggcggtcaaatctcagcaaggacatgatgtgtcattaaaagcagatacagtctgcattcatggagatggagcccatgcgctgacatttgcgcaaaaaatcagaaaacagctcaaagcggctggaattgaagtgacagctatttcagaacagaggtcaacataaaggaggaacaatagatggagcagcagaaaaagacagcaggaaaaaaagcgggcagctggtcattgctgatgggcgccgcctttttaatggcgacatcagcaatcggaccgggtttcctcacccaaaccgcaacattcacaaacacactcgcagcaagcttcggttttgtcatcttaatctctattattttagatattttcgcccaaaccaatgtgtggcgcatcatcgcagtttctggaaaacgaggtcaggaaattgcgaatatggtgcttcccggactggggtatttcatcgccattctcgtcgtgcttggcggactagcttttaatattgggaatatcggaggggccgggctggggcttcaggtgctgttcggcattacacctgaaacaggcgctttaatcagtgccgttattgccattttgatttttgtcatcaaggaagcaggaaaagcgatggaccgttttacgcaaatcgcggggttcgtgatgattattttaacggtctacgttgcggcgacgacagctcctccggtcggacaggcagtcgcaaatacattcgtcccggaacacatcagcatatttgccattgtcaccctagtgggcggaaccgtcggcggttatatcacatttgccggaggacaccgtttgcttgatgccggaattaaagggaaggaatccattccgcaggtgacaaaaagctcggttgtcggcattttaattacatctgtcatgcgtatcgctctttttcttgcggttctaggcgttgtatcgaaaggcctgcacatcgatgaaagcaacccggcggcttctgttttcaagctggctgctggaaatgtcggttataaaattttcggattgatcatgtggtctgcggcgattacgtctgttattggagcagcctatacatctgtttcattttttaaaaccttttctccaaaaattgaaaagaattcacgcggtattattatcggatttattgtggtttctacgttagcttttgtcacaatcggccagcctgcgaagatcctcgtccttgtcggttcactgaacggcttaattctgccgattgcgctcggaacgctgcttgttgccgcctacaagaaaaacattgtcggtgattataagcatccgctttggctgacaagcacaggcgcgcttgtagtgattgtaatggcagttatgggaatctacacgttatgtacacaacttcctcaattgtggagctgatataagtggagcaattaaacaaaatggcgccaaaggatgtacgcgccctgatacgagaggggaaaataaacgggccgaccgcaggcatgtccggcggctacgcccaagcgaatcttgtggttttgaaaaaggaccttgcgtttgattttctgctgttttgccagcgaaatcaaaagccctgccccgtgctggatgtgactgaagcaggttcgcctgtgccgtctctggctgcgcctgatgctgatatcagaacggactttccgaaataccgtatttacaggcacggtatcttaacggaagaagtatctgatattacgccatactgggaggacgattttgtcggctttctgatcggatgcagtttctcctttgaacaggcactgatcaataatgggatagctgtccggcatattgatgaggggacaaacgtctcaatgtataaaacgaatatcgattgtgttccggcgggggcgtttcacggacagatggttgtcagcatgaggccggttcctgagcggctggctgtacgtgccgcacaagtgacttcgcgttttccggctgtgcacggagggccgatccatattggcaatccgggagcaatcgggattcgcgatctcgggaaaccggatttcggagatgccgtttccattcgtgacggcgaggttcctgttttttgggcatgcggggtgaccccgcaagccgtggctatgaatgtaaagcctgaaatggtcatcacacatgcgccggggcatatgctcatcacagatattcgagacgagtcgcttgcggtgctgtagcctctcgtcatcctgatgaacgagaattaaaagaggtgagaaagatgactgtacgatatcaaatcgaacagctcggtgattctgcaatgatgatccgattcggagaagaaatcaatgaacaggtcaacggcattgtccatgcagcggccgcttatatagaagaacagccatttccgggattcattgaatgtattccggcttttacaagtctaaccgtattttatgatatgtatgaagtgtacaagcatttgcctcaaggcataagctcaccttttgagaaggtcaagcgcgatgtcgaagagcggctggtagaaatagccgaagactatgaggtcaaccgccgcattgtagaaattcccgtctgctatggcggtgaattcggtccggatttagaagaggtggcgaaggtcaatcagctgtcaccggaggaagtaatcgacattcatacaaacggtgaatatgtggtatatatgcttggcttcgcgcccggttttccttttctaggcgggatgtcaaaacgcattgcagctccgagaaaatcatcaccaagaccgtcgattcccgcaggttcggtcggtattgcgggattgcagacaggcgtttatccgatttcaacgccgggcggctggcagctgatcggcaaaacgccgctggctcttttccggccgcaggaaaacccgccgacattgctgcgggcgggagatactgtgaaattcgttcgcatctcagaaaaagactatcacgcctataaggaggagtccaattgagcatgaaagtattaaagcccggactgctcacaacggttcaggatataggcagaacgggttaccaaaaatacggcgttctggccagcggcgctatggacacggtttcactgcgcattgccaatctgttgataggaaacggcgaaaatgaagcaggtctcgaaataacgatgatggggcccggtccgtcgtttcatttttcaaaacagacactgattgctgtgacaggggcggacttcacgctgcttattaatgacgaggaagcgcctttatggaagcctgtgctcatcaaggaaaacagcacggtcagctttggcccctgcaaactcggcagccgtgcttatttggcggcagccggcggcatcgaggtgcctgccgtcatggaaagtaaaagcacatacgtcagagcaggcatcggcggacttcatggcagagcgcttcaaaaagaagatgaactgaacattggagagatgtcagctctttcgcaaaccatcctttcccgcttaagttcgcagcttggaaaacagggatttgcagcaccgaagtggtcagtcagccgcggcagatttctgccattgaagaagaatcccgtcattcgggtgctggaaggaaagcaatttgcctttttcacagaagaatcaaaaacgcgtttttatcaagaagcatttcgtgtcacgccgcagtctgaccgtatgggctacaggctcaaaggagaaccgctcgaactgaaggccccgcttgagatggtgtcggaagcggtttcattcggaacagttcaggtgccgcctgacggcaacccgattatcctgcttgcagaccggcagacgactggcggctatccgaggatcgcgcatatcatatccgctgatcttccgattgtttcccaaatcatgccgggtgagcacgtccagtttgagcctgtatcccttcaggaagcagaagcgcttgcgattgaacgggaacagcatataaaagaactgaaaacgagaataaagatggaatggctgacatagcaaaggggatgcatgatgcagaataaaaacaaaaccgtagtcaaatctatggcgctgctcaatttgtttttgcataaaccaagcctaaccttaagtgaactggtgtcgctgacgggaatgccgaagacctctgttcaccggatggtcagctctttggaggaaatggggttcctcagtcgggatgcgtccggcgcttattcgctgggattggtgtttttggaattcggacagcttgtcgctgacagactggatatcagaaaaatagcgaaaccggtgatggaagagctgtgccgggaagtggatgaagccgtgcagttgatcatgagggacggcaatgaagcgatatacgttgagaaaatagaagggacacagactgtgcggctgtatacggcgattggcaggcgttccccctatacgcgggagcgtgcgccagaagcattctgtcctttcttccccgtgaagaaatcgaagcatacatcaaacaaaccgagctcatttcgattggctccggaacgattaccgatcccgaaaaactgcttcaggagattgatgcctctgtgcaaaatggctatactgtcagctattcagagctcgaaaactatacggcggcgatcggcgccccgatctttaaccataagcgccaggtggcagccggcattagcattgcaggctttgaagcgagatttacagaagacaggctgccctatttaacagaaaaggtgaaggacgccgctttacagatttcaagaaaaataggatatacataagtagccaatcttttctctgctgcgtacattaacgtatcgacgttcaagagtggaggaaagaacatgatgcttcgatatacagctctgggcgattccttgacgacagggagaggctcggggctgttttcacccggcttcgtccagcgttttggggacatgatggaagctgacttgaaaacaagaacggcaataaacatatttgccagatcaggcctgaatacagaagagattttgggactcctgtcatatccctatgtgcaaaaatgcattcgagatgctgatatgataacgatcacagggtgcggaaacgatctcatcgattcggtcttagcctaccaaacctctaaggatgaaacgattttcagccgtgtatccgcccattgccatgagaattttgaaaagatgattgccaaaatcgccgagatcaaaggagaaaatccttccccgtacgccatccgagtgttcaacttatacaatccgtttcccggcattgaaatcgccggcaaatggatcacatcctttaattcacatttagaaacacttgcatcagcaccccatgtcaaaatcgcagatgcctatagcatcttcaaaggcaaggagcgggaatatctgtcctttgacggtgtccatccgaactgcaaaggctatcaagcgatggctgaagccgttcacaagctaggctataaagaattatcagtttcatagaaaacgcgcctcatgacaggcgcgttttgtatgtgtgatcgaaatattaaaagaaacttaaaattccctttcttctgttctacagacaaacaaagtgcgctagaataatggaggacgtaggcaaatatagccataacgttcaatatttcgtatataaggaaggatggtccttttgtttcggatttttaaaatgtcttttgcggttatcattattatactggcgcttattgcttttaactatacggaacacacctctgttatccaatcggtcatgctcgtctttcttggtgcggtcatgtttatgcagggacttgaagagcgcaaaaaagaaaatgacggctcaggcgcttttaatatttataccgccgtttttgtatggtctgtctcccttatcggttttacacttcatattatataaatctattacacatcctgaaaatgctcgaccgtcgggaacggggtatagaaccgatgaagcaaggctttccactcttgatactctgaagaaccgcgaaagccttccgtatggtcctcaagtgtttcccactccacaagaagcagatatttatgcgtttcctccatgcattttgataacgagtgagtgatatagcccttcatgccggaaataatcggcgccgcttgccggaatgcatcctcaaactcttgttcaaggccttctttaatgtgaagcattgctgcctctctgaccatgctatcccttctttctgtcttttcaaatagtctacagcaaacgataggagatttctgcaaaatcggtgaacttttccttcattttcaaaaaaatcttgcacgcaccaattcaattaagagaaaataacaagtggaaggcaggggaaagtcatgttaaaaaagtgtattctactagtatttctatgcgtcggattgattgggttaatcggatgctccaaaacagattcaccagaggatcgcatggaagcattcgtgaaacagtggaacgatcagcaattcgatgacatgtatcaaagcctgactaaagatgtcaaaaaagaaatctccaaaaaagatttcgtcaacaggtataaagccatctatgagcaggccggcgtaaaaaatttgaaagtcactgcgggagaagtagataaggacgatcaagacaacaagacaatgaaacatatcccgtataaagtcagcatgaacacaaatgccggcaaagtcagcttcaagaatactgctgtgctgaaattagaaaaaacagatgacgaggagtcatggaatatagattgggacccatcgtttattttcaagcagctggctgacgacaaaaccgtgcaaattatgagcattgaaccgaaacgaggccaaatttacgataaaaatggaaaaggtttagctgtcaatacagatgttccggaaattggaattgttcccggagagcttggcgataaaaaagagaaagttataaaagaactcgccaaaaaacttgatttgactgaagacgacatcaagaaaaagctggatcaaggctgggtaaaagacgattcgtttgtgccgctcaaaaaggtcaagcctgaccaggagaagttagtttctgaagcgacgtcattacaaggcgtaacaagaacgaatgtcagctcccgctactatccgtatggcgaaaagacagcccatttgacaggctatgtccgcgccattacagcggaagaactgaagaaaaagaaagaaggaacgtacagcgatacgtctaacatcggtatcgccggacttgaaaatgtgtatgaagacaagctaagaggcacaactggctggaaaatctacgtgccgcaaaccggggaagtcatcgctgaaaagaaagcaaaggacggcgaggatcttcacctcacaattgatatcaaaacgcaaacgaagctgtatgatgaactgaagaatgacagcggggcggcagtcgccctgcagccgaagacaggcgaaacactcgcccttgtcagcgcgccttcctacgatccaaacggatttattttcggctggagcgataaggaatggaaaaagctaaacaaagataaaaacaatccgttttcagcgaaattcaataagacatacgcgccaggttctaccattaaaccgattgcggctgctattggaatcaaaaacggcacccttaaagccgatgagaagaaaacaatcaaaggcaaggagtggcaaaaagattcgagctggggcggctattcagtgacacgtgtttctgagagacttcaacaagtcgatttggaaaacgcccttattacgtcagacaatatttattttgcccagaatgcgcttgatatgggagcggacaccttcacaaaaggcttgaagacattcggtttttcagaggacattccgtatgaattcccgatccagaaatcgtctattgcaaatgacaagcttgattcagacattttgcttgcggatacaggctatggacaagggcaaatgcaaatgtcttcgcttcacttggcaactgcttacacgccatttgttgacaatggagaccttgtcaaaccgacgctgatcaaaaaagattcacaaacagctgatgtttggcacaagcaagtggtcaccaaggaaggagcggcagacattacaaaaggtctgaaaggcgttgtggaagatgagcgcggatcagcgtatcagcctgtcgtgaaaggaatcacagtggccgggaaaacaggaacagccgagctgaaaacatcaaaagatgataaagacggcacggaaaatggctggtttgtcggctacgattacaaaaacaaagacctgcttgtcgccatgatgatccaaaatgtgcaggaccgcggcggtagccactatgtcgttgagaaagcgaaaaagcaatttcaatcgaattaaaatgtctttttaaaaggagcgaaaggaaaaaggggatctgaggccgaatgaactagtaaggggcaaaacccggtttatacaaagaaaagagggattttgcatgcagcgtattcaattggcggaggatcttcaattttcaagagtcatacacgggctttggcggctgaatgaatggaactattcagatgctgaacttctaagcctcattgaatggtgtatcgatcacggcatcacgacctttgatcatgcggatatttatggaggctatacgtgcgaaaagctgtttggaaacgcccttgccctttcgcctggattaagagaaaacatagagctggtcacaaaatgcggtatcgttcttgaatcgcctgaacggcccgctcacagatcgcatcattataacacaagcaaatcgcatattttggcatccgttgagcaatcgcttatgaacttaaggacggattatattgatgtgctgttgattcacagaccggacccgctcatggatccggagggggtagcagaggcgtttcaggccttgaaatgctctggcaaggtcaggtactttggcgtttcaaattttaaagatcaccagtatcggatgctggaatcgtatttgcctgagaagcttgtgaccaaccagattgagctttccgcatacgaattagaaaatatgctcgacggcactttgaacctgtgccaggaaaaacggattccgccgatggcttggtcgcctctggcaggcggcaaagtattcactgaaaacacggataaagaccgacgtgtccgcacggcgcttgaatccgtccaaggggaaatcggcgccgcttcattggacgaggtcatgtacgcatggctgtatacgcatccggccggcatcatgccgattgtcggaagcggaaagcgcgagcggatttccgccgcgataaatgcgttgtcatacaagcttgaccaggatcaatggttccgcatttttacagccgtacagggttacgatattccataaaaagcatcagcttaccagctgatgctttttcaatattgtcacaccgcatagtgccaaattaccatttataagtgattgattcttgcttgaaagcgttttatattaaaaggaaacctctctatatcctctactgcatctccttgcgacttcatccgcacatcaagatagtctaggaggtcttttttatgtatatgactgccagagaacaaaagctgttaaagcacttattattacaaaacagatatataaccgtaactgagcttgctgagctgatgcaagtcagcacgagaaccattcacagggaactcaaatcaattaaaccgctgatggaaaccgtggggcttacgttagataaacagcccggtaaagggttgaaagcagtgggaagtcccgaagataaacaaaagctgcttactgatttatcatatgaacagcatgaatacagcgccgacgaacggaaactgctcattctttgttcgttattagagtctcaggagcccgtcaaactgtacacgcttgctcatgatctccaggtgacgaatgccacggtcagctatgacttagatgagctcgagaagtggatttctcccttcggactgacactgatccgcaaaagaggttttggcatccagcttatagggccggagaatgcgaaacggaaaattgtcggcaacttgattgtgaaccgtctcgacatccaaatgtttttggaagcggttgaattaaacatcaaaggaaaaaccgattcttcagagaaaatgttcggggttgtcagcaaaggtgagctgttaaaaatggagcgcatcttatttcagctcaaagaaaaaatcgctttttcattgtccgacagctcctatatagcgctcgtcgtccatctgacgtatgcgatcgaacgaattaagcttggggaaactatcaccatggagcaaaatgagcttgaggaactgaagaatgcgaaggaatacagctccgctcttgaaatcgcgggtgagcttgaacgtgccttcggcgtgacgattccagaggcggaggtcggctatattacaatccaccttcgaagcgccaatcgaaaatacaaaacagaatacaaagcgcaggaaattgagctggaaacagccctgcaaacaaagcggctcattgcttttatttcagacaaaatcagaatggatctgacgaaaaactactctttatatgaaggcttgattgcccatttggagccggccgtcagccgcataaaagaaaatattgagatatacaatccgatgaaggaacagatcaagcgcgattattttctgctttatatggcgatcgaagaaggcgtcgaaaagtattttccgggcatgtccttttctgatgatgaaatcgcttttatcgttcttcactttggctcggctcttgaaatcaaaaaagaagaagcaaaagtgaaagcgcttgtcgtctgctcaagcgggatcggctcctcgaaaatgcttgcctccagactgaaaaaagagctgccggaaattgaatcgtttgatatgtcatccctgatcgagctaaaggggaaggatgttcaagcctatgatatgattgtgtccactgtaccgattccttatgaaaacattgattacatcatggtcagcccactattaaatgaggaagacgcaaaccaggtcaagcagtatatcaagcggaagattccccttattcttaacaaaaaaagaagcccgaaggaagaagcgcagcaagctgatgtacctgacatgctagaggcggcggaaagcatagggcggtatatggaagttatccaagatgttctgcgccattttacgctagctcaactcaaaacaaacccggaccatagcatgcttttgctagagctttttcaacagctgaagaaggatggcctgatccgtaatccggaaaaagccgcggtttgcctggctgagcgggagaaacaagggggattgggaatccccggaacaaacatggcgctttatcatctcaaaaatgatgaaatcgtcctgccttttttcaaaatgtttgatctcagcacctcctatgaagtggatggcatggacggaaataccctcaggatgacacgcatcctcgtcatgatggcgcctaactcattatctgctgaaggctcggagattttaagcgcgatcagctcggcaattatcgagagcggagaaagcatggcggggtttcaggaagaaggagaacaagaattgtatcagcggttaaaccgcatatttttcacatggatgaaagaaaaaaacatactgtaatcctgcatggcacacgtcaaaaatttggcgtgtgtttttctttggacggggaacaaaataagaaaatgtgggactattttatcattcagtattggaataattccaaaatgaaatagttttacaagttatcttttttgggttaaaatgggtgaggtaaggaagaaaatctaacaaattattgaagattcaagagaatataggagatgacgatatggaaacattacagcatctgattctgcatgacatgccgaatagcgaagatatagaggctgtaaaaagcggagaccatacactgacatataaaggttaccgtaaacggattaatcagctggcgaatgccatgcttcaaaaaggaattcaaaagggcgaccgtgttgcattgctttgcaaaaacggccatcccgcctcaacagttatgttcgccgcacttgaaataggtgctgttgtcgtacctgtcagctggcagctgaaaccatatgaaatgacaggcattttaaaagcaagtgaaccgaaagcaatgttttacggagcggagtttaaagagacactagatgaagttcttcctgaattgtcctcactgtgtgtaacaatggaaacaggaacagcttacgaaacatctgctgaatttgaagcgctgtttgcaggtcctgatcatttgccagagacggaaatggtttcccctgatgatacagcacttctgatgtttacatctggaacaacgggtaacccgaaaagatgcatgattacacatggcggcatatacagatacgttaaaaaatccaacagctcaatagcacgcatgaagggccttcgttttctcgcgtgccatccgatttatcatacgagtgcgctcatttgcatcatgcttggaacgtttgcagaaacaacctttgtgtttacaaaggatcaagatcctgttcacatgctgaaggtcattgaagaagagaaaattcagaccgtgatggctcttcctgtgttctacacgtatttgcttgaggcgtgggaaacgcaccaaactgacttatcttcgcttgttattttaatgacaggcggaacaaaagtgccgagcagcctaatccgccgctatcttgatattggcattccgcttgcgcatggctatggaagtactgaggcttggggcatcagcacatggacgcctgatatgggaatggataaagcggcatctgcaggaaaacctgtggcaggtgttaaagtcaaagtggaagatcctctgactggagaagaacttcctcaaggacaaatcggcgaaatcgttgttcatactccattcttatttaaaggctatgaagacaatcctgaagcaacagcgaaagtgctgcaaaatggatggtttagaaccggagattcaggatatgtagatgaagatggctttattttcatcacgggacgctacaaggatgtcattatttacggaggcgataacgtctatcctgatcaggttgaagaagttatccagcagatcccgggaatccttgaaacggctgtggtcggtattccagacccgctttacggtgaaaaaccgaaagcttttatcgtgaaaaatggcggccagcgcatcacggaagaggatgtcatcgcattttgtaaagaacgcctgtccgcttacaaaatacctgaagttgaatttgttaacgaactgccgaaaaacaaccttggcaaggtgaaaaaagacgtcctgcgcaatcaggctgtacattcataaaagaagaagcccgtccactttatgtggcgggcttctttgcagttgcacagacggaaagctcaggcttaatgttcttaaattctatatcaatgtcttcgaagccggctgctttaaagtcagcattcatctctcttccaaatgatttggttttctcaggactggcatccgcttcccgcggctgcatcgtaatggctgctttgccgcctggctttaatgcccgataaatctgtttcatgccttttgtttggtcattccaaatggtgtagttgttaacggaaatcactttatcataaaacgaggcggggagaggaaatgtctcgatgcttccttgtatcaggcgtacgccctttggtttcactctgcgggcggccagcttcagcatggcctctgacacatcaatcccatgaagatgaacatccttctcgcgtttcagcatctgctgcatgcagtatcccgggccaaacccgacttctaaaatgctgtccccgcgcgtgatacccagctgattgattgtccactgattcagtgtttgattttcagcagccatgatgtacccggcaatcatgccgatgacgccctttggcctgctgaatcttctagaaagcatgttaatcattcagcaaccaaccccctttttgagttaatttcctcccagcgttccatgtgaaacatttttctgataaagcaatgcgaaggtgccaagccatgtttatccatagagtgtgtgaggtacacaacaaatagacatgaaaacaaaggaggagaatcatcatggcaaattatccaaaagaactgccggcacaaactcaaagtcgccagccgggaattgaaagcgaaatgaatccaagtccggtgtatgagtacgaggattataaaggagcagacaaattaaaaggaaaagtagctcttattacaggcggcgacagcgggatcggacgcgcggtttccgtcgcttacgcaaaggaaggcgcagacatcgccattgtgtataaggatgagcatgaagacgctgagaagacgaagaaacgtgttgaacaagaaggcgtaaaatgcctgctgattgctggtgacgtaggtgaagaggaattctgcaatgaagcggttgaaaaaacggtcaaggaactaggcggccttgacatccttgtcaacaatgcaggtgaacagcatccgaaggaaagcatcaaagatattacgagcgaacagcttcaccgcacattcaaaacaaatttttattctcaattttatttgactaaaaaagcaattgattacctgaaaacgggcagcgccatcatcaatacgacatccatcaacccgtacgtagggaacccgacactgattgattatacagcgacaaaaggggcgatcaacgcctttacaagaacaatggcgcaggcgcttgttaaagacggcatccgtgtaaatgcagtcgcgccgggtccaatctggacgccactaatcccagctacgttccctgaagaaacagttgctcaatttgggcaagatacgccgatgggccgtcctggacagcctgttgagcacgtcggctgttatgtgctcctggcatcagatgagtcctcttacatgacaggacagaccctgcatgttaacggcggaaactttgtgacgacataagagggagtgagacatatgggcatcacgaaagaagaagtgaacagctactatcaaaaagcagggattgtattaacggacgaggaagtagaccaaatccagctgatggattacggcttaggaaaagaaagaaaagtcgggctccagctcttcgtctacgtcaatacagaccgttattgttcaaaggaattggtgctgtttccgggacagacttgcccggaacaccgccatccgccggtcgacggccaggaaggcaagcaggagaccttccgctgccgctacggaaaagtgtatctttacgtagaaggagaaaaaacgccgcttccaaaagttctccctcctcaggaagacagagaacactatacggtctggcacgaaattgagctagaaccgggcgggcaatatacaatcccaccgaatacaaagcattggttccaggccggggaagaaggtgccgtcgtgacggaaatgtcatcgacgagcacggataaacatgatatctttaccgatccaagaatataaggatgggcttaacagcccatcctttttgtattgaaaaaaacagaatcatcgctataatggttaaaaaaggaaagagggcgaggcaatgttcacttgcaaggtaaatgagcacatcaccatccgattattggagccgaaggatgcggagcggctggccgaactcattatccaaaatcagcagcggcttggcaagtggctgttttttgcggaaaatccaagcagcgctgaaacgtaccgagaaacaatcattccagattggcggcgccagtatgccgacctgaacggcattgaggcggggctcctttatgacggcagcctatgcggcatgatcagcctgcataaccttgatcaagtgaatcgtaaggcggaaatcggatattggattgccaaagaatttgaagggaaaggcattattacagctgcctgccgaaaactcattacgtatgcttttgaagagcttgagctgaatcgtgtggcgatctgtgcggctgtcggaaatgaaaaaagcagagcggttccggagcggctcgggtttctagaggaaggcagtgcacgggacggcttatacgtaaacggcaggcatcacgacctcgtctactacagtctgttaaagcgtgaatgggaaggcgaaaaataaagagcacactttcttgtttaaatcttccccggatgtggaaaagtaacagcggagacgttaaaaaggagtgattcgagatgaatcagcaagacattaaacaaaaagtgcttgatgttctagatcaccataaagtaggttcgctcgcaacagttcaaaagggcaaaccgcattcccgctacatgacttttttccatgacgggctgacgatttacacaccgacaagcaaggaaactcataaagcggaagaaattgagaacaaccccaatgtccacattttattaggctatgattgtgaaggttttggcgacgcatatgtcgaagttgccggaaaagccaaaatcaacaattcggcagaactcaaggacaaaatatggagttccaaattagagcgctggtttgacggcaaggatgatccgaatctggtgattcttgaaattgaaccggaggatatcagattaatgaatgccggggagaaaacaccggtctcactcgaactataaaaaatttgtgttttcaagggcgatatgttattatgaatagctagtaagaaaaataagcaaataaaaaagaaagtaaacttcttttttctgttttgagagagaagcttaccgcttcccaagcagcataaccagctgcccttattcttttccttcataacaaatcgcccctaacgatgagatggaaaaaagacttttttgttttacaattcacaccggcgcggcttcggagccgcagtgacgattgagaggtagggctttcgttgtcttgtgttcaagaaatttccatggtgtttactttccagaatgattcttcggaacaatgctttatgaatctaacccgcctgacttggcggatgatataatctttatttgcgtatagaaaagaataagacaaaccgcccggcgtacgccggacggtttttttattgcaaaaaacacatcgtactgaaacctccttgtcttcattccagtcttatctctaggatgaaattggaggaagaataacgtgcatgtcattacaacacaagtactttttattttttgttttttattgctgattcactcgatagaaactttagcctatgccacaaggctttccggggcccgcgttggatttattgcgtccgcgctttctctgtttaatgtcatggtcatcgtatccagaatgtcgaacatggtgcagcagccctttaccgggcatttaattgatgatgctggaaaaaacgcactggcgattgtaggggagcagttccgctttttaattttcggatcgacagtcggcaccattttgggcattatcctgctcccgtcttttgtcgctcttttttcacgggcgattattcacttggcaggcggcggcggctccgtttttcaagtattccgaaagggattctcgaaacaaggattcaaaaatgccctttcctatttgcgtctgccgtctatttcatatgtaaaaggatttcatatgcgcttgattccgaagcgtttgtttgtcatcaacatgctgatcacatcgatttatacgattggcgtgctttcggctttatacgcaggccttctggcgccggagcgcagtacgacagccgtcatggcttcgggtttgatcaacggaattgcgaccatgctgctggccatttttgttgatcctaaagtatccgttctagctgatgatgtggcaaaaggaaaacgaagctatatctatttaaaatggacctctgtcacaatggtcacatcaagggtggcgggcacactcctcgcccagctcatgtttattccgggggcctactatatcgcgtggctgacaaagtggttttaataaaaaaggctggatcataaaaatccagccttttttgcgttcccttatttatatttccttaatccgcggtcgtacaaaaaatttccgaatgggacgaaagcggcgacgaagccggcagctgaccatttcagcggccatttgacagagaaggttgcataagccaagacaagcaaatacaaaatgaacaacccgccgtgaaccgaaccgacaattgtcaccgcaagcggaaggcctgcccaatatttaagcggcatagcgatgaacaacaggattaagagtgacattccttcaataaaacccatcgtgcgaagtcttccgatcggcgtttgcagcataaatcgccctccttgtggacacgttttcattttatactataaacaatctggggggcatatgacagctttcaaaaaatgttcagaaaacattcatttttacatgccttttctagggaactgtacttgtcatttacaaagatacccgagataatgtgtacaaaatcaaaaaagaaggatgttgaaatgaaacttgaccagattgatctgaatatcattgaggagctgaagaaggacagccgtttgtcgatgagggaattaggcagaaaaattaagctgtcgccaccatctgtaacagaacgggtaagacagcttgaatcgtttggcatcatcaagcaatacacgctggaggtcgaccagaaaaaactggggcttcccgtttcctgcattgtggaagcaaccgttaaaaacgcggattacgagcggttcaaaagctatattcaaacattgccgaatattgaattttgctaccggattgcgggtgcagcctgctatatgctgaaaatcaatgccgaaagcctcgaagcggtagaagatttcattaacaaaacatcgccctacgcgcaaaccgtcactcacgtcattttctcagaaattgacacgaaaaacgggcgcggttagagagtgccgcgcgaagtctgttataataacaggatgagcgtgaaagaaagagaagtgatcaagcatgtcaaaaacagttgtattagctgaaaaaccttcagtcggccgggatttagcccgggtgctgaagtgccataaaaaaggaaacggttatctcgaaggcgatcaatatattgtgacctgggctttaggccatttggtgacgcttgctgatccggaaggctacggaaaagaatttcaatcatggcgcctagaggatctgccgattatcccagaacccttgaagcttgtggtgataaaaaaaaccggaaagcagttcaatgcagtcaaatcccagcttacccgtaaagacgtcaatcagattgtcatcgcgactgacgcaggccgggaaggtgagcttgttgcgcgctggatcattgagaaagcgaatgtccgaaaaccaatcaagcggctgtggatttcatctgtgacggataaagcgatcaaggaaggttttcaaaagctgcgcagcggcaaagaatatgaaaacctgtaccattctgccgtcgccagagcggaagcggattggattgtggggatcaatgccacccgtgcacttaccacaaaattcaatgcccagctctcatgcgggcgtgtgcagactccgacgcttgccatgattgcaaagcgcgaggcagacattcaagcgtttacgcccgttccgtattacggcatccgtgctgcagtcgacggcatgacgctgacgtggcaggataagaaatcaaagcagacgagaacgttcaatcaagatgtaacaagccgtctgctaaaaaatctccaaggaaagcaagcggtcgtagctgagctgaaaaaaacagcgaaaaaaagctttgcgcctgcgctttatgatttaacggagctgcagcgtgacgcccacaagcgcttcggtttttctgctaaagaaacgctttctgtactgcagaagctatatgagcagcataagctcgtcacatatccgcggacggactctagatttttatccagtgacatcgtcccaacgttaaaagaccgtctggaaggcatggaagtaaaaccgtatgcccaatatgtcaaccaaattaaaaaacgcggcattaaatctcataaaggatatgtcaatgacgcgaaggtgtcagaccaccacgcgattatcccgaccgaagagccgctcgttctcagcagtctgagtgataaagaacgaaagctgtatgacctgattgcgaaacgtttcctggctgtattaatgcctgcattcgaatatgaggaaacaaaggtcatcgcagaaatcggcggagaaacctttacggcgaaaggcaaaaccgtgcagtcgcaagggtggaaagccgtttatgatatggcggatgaggatgatgagcaggaggatgacagagaccagacacttcctgcgcttcaaaaaggcgacacacttgccgtccgcacgttaacggaaacaagcggccaaacgaagccgcctgcccgctttaatgaagggaccttgctgtcagcgatggaaaacccaagcgcatttatgcaaggagaagaaaaaggcctcgtcaaaacgcttggagaaacaggcggcctcggcacggtggcaacgcgtgccgacattattgaaaaactgttcaacagctttttaatcgagaaaaaaggccaagatatttttatcacatctaaaggaaaacagctcctgcagcttgttccggaggatctgaaatcaccggccttaacagcagaatgggagcaaaagctgtctgcgatcgcggccggcaaattgaaatcggctgtttttattaaagatatgaaggcttacgctcaccaaacggtaaaagaaatcaaaaacagcagccaaaccttccgacatgacaacatcacgggaacggcatgtccggaatgcggcaaaatgatgctgaaagtaaacggcaaacgcgggacgatgctcgtgtgccaagatcgtgaatgtggaagcagaaaaacgattgcccgaaaaacaaacgcccgctgcccaaattgccataaaagaatggagcttcgcggccaaggcgagggccaaacctttgcgtgtgtgtgcggtcaccgtgaaaagctctctgtatttgaaaaacgaaaaaacaaagacaaagcgcgtgctaccaaacgggacgtatcctcttatatgaaaaaacaaaataaagatgagccgattaacaacgcgctggcagaacagctgaaaaaactcggtttggataaataataaaaaaacctgtgcctatcgcacaggtttttttagtggacttaggtcctgttttcttaatgttcaaaaaggggaaaaaaagctagcaatctgcatttttttcttttatagtaaatgtactttgtaacatggcagtcatattttcgtctataactatttgtgagcgtctgatttgcttcaggcgacaaagggggatttgcctgtgaggcatgtactaattgctgtcatcttattcttcttatctatcggactttccgcagggtgtgctgaagctggaaacaagacccaaaatcagtcggcgacagaagtgaatgccagcccgctccagccggcggaatatttcatctatcacaatttaatgaatgacaaagggctgatcaaaaccgatttttcagaccagccttcttacttgtcggaatctctcggcctgtggatggagtttctgctcagcaaaaatgacgcaccgcatttccaggatcaatatcagcatctgactgattcatttctgatgagcaatcacttggtgacgtggaagattcaaaatggccaagcgagcgggacgaatgcgctgatagatgatatgagaattatgctgtctcttgaccaagccgccgcaaaatggggccgcagcgactacgcgcaaacggctagggatatcggcacgtctttgaagacatacaatatgaacaatgggttatttacagactattacgactcacaggccgcttcaaaggatgtgacgctttcatacgtcatgcctgacgccttagctgtcttaaagaagaatggaatcatagacgaagacacagaacagcggaatgccaatgttctctattcagctcctttaaaaaatggctttctgccgaagacatacagctcggagacgaaggaatacacatatgatagtgaaatcaacctgattgatcagctttacgctgcttggcatttgccggaaggggatgaaaaagcatctgttttagcggactggatcaagcaggaatttcagaaaaacggaaagctgtacgggcggtattcggcagatacgaaggagcctgccgtccaatatgagtctccatccgtatatgccttagccgtattgtttttgacaaaacagcatgaaaacagttctgtcatcaaagccatatatgacagaatgaatgactttgaaattcatgatccggtgaaatcgtattatggaggctatatgagcggcactcagacgcattcatttgacaatctgctgccgctgttagccgaaaggaagctttttaatgaaaatatcattcagtgaatcacaaaaattatttgcttatttttcagggctcatcgcggccctgtctttgtttatttattatgtgtcagcccagcaatcagaaggtgctctgatcctttgcatcacatttggcgtcatcgccgcaggcatctggttcggcccgatttacgcgctggcagtgaccttaatcgtactctttgttctcggcaccttaatgatgtttttccagactggacagacatcgctctttccggctgaggaagggctgcgaatgcttgttgtgtggggaatcgcgcttttgctgttttcttttatttctggaagaatccacgatattacagcagagcttcggcgctcaataacacggcttcaatccgaaattaaaagctatgttgctgttgacagagtgaccggatttgataacaagcaaaggatgaggctggagctttcagaagaaatcaagcgggcggagcgctatggcaattcttttgtttttttgctgctgcatatgcattatttcaaagagtttaagtctttgtacggtgaaaaagaaacggaccgcctcttccaatatgtcagtcagcaaatcaggacaagcgttcgggaaacggataagaaattccgtccctctgatgagcgtatcgggatcgtgctgacgcacacgcctgctgaacatatgccggcagttctgactaagctgaagaaacaattggatacatatcagctggaaaatggaaagtatgtgtcgcttacgttccacgtttgctatttgccctaccgcaacgatatcaaaacagctgatcaatttttagaagaactggaaaacgagatgatgatgaatgaactataaaggaatcacattgccatgcgtcatgatgcttctatttttagctattgcgtcttttcccgtttctgcgcaagcgaaagatcaagatgccggcattctcatcatctactcaaccttggacggcaaagagtcgtcacaagtcaaaatgctcgatttgcttgcgggccactttacatcccatgtgacagtcaaaaaagattcagacgttgaagcatcggatttcaaagggaaagaccatgtgatttatttcggccaaacgaaaagaaagctcagcaaaaaattgctgtctctgatcagcggcgtaaaaaaaccggttgtcgccattggctataacgcaggccaaatcagccaattttccgggctttcattagcccgcaaagaaaatgtgtttcaggttcacagcaggtcggaaaaggccgatgtgtctctggaaagcgggcttaacgtgctgagtgtatcaggcctgaaaggaacggcgctttacaccttcaaagccgatgacggcacaacgcattcttttatatggaaaacaaaaaaagggaatgtgtacattggattaacaaatttgttaaatgacaatttgatcgtggcgaaacagctcagagaagctttcggagagaaggcggggacgacgttattgtatttgcgtctcgaggatatcagcccgatgtctgatgaaaaattgctgcttcaagccggtacatacctgcataagcggcatattccttttatcctggcggtcattccggtttacttgaatccggaaacaggcgacaaagtgtatttgtctgatcaaccgaagatggtcaaggtgctgaagaagctgcaaagcatgggcggcagtatcattgttcacggctatactcacgcttatcgctacagtgaaacaggagagggctttgaattttgggatgcaaaggcggatcagccgattacatccggaaatgccgaagaccccccgtccattttggagaaagaacaggacttcccgaacgaacaagcctatcacagctatctcgaaccatttcgggaaaaggaagaaacgtatacaaaacaaaaactgacgcgtgccattgaggatttgacatcatcgggtctttacccgctggcgtttgaagcgccgcattacacgatgtccgattatggctatcaaatcgcctcgcagtattttacaagcattttcggccaggtccagctcagcagcacaacatggaaaacatccggtgcacctccgtttgtgactgctccttcgatgttgcacggaatgacgctttatccggaaacgatcggctttgtcgacacatcaaagcaaaacccgatcggtgagatggaggagcacatctcccagatgattgattttgaaggcggagtagccggaggattttatcacccgtacctcgggatgaaatatctgccggagctggttgatcagatggaacgcattccagacagtgaatggcttgatttaaagaaaacgaaacaaaccgtcaaaacagacaaagtggaaattcatacaagcggtgacggaacgattcaggtgaaaaacggcgtaagcgccattgacgagtttttcgatcatcatcgccaaacccctctggaaaaggcgttatggattctctccgctgttgtgctcttatttgtcatcatgtttgtcagttatacgttttacttgagagccacattgaaaaaacgaatttttaaggagagaagaagccttgggtaatacgctgttctttatctcgctaagtttaatatgggttatgcttctctaccacatgttcctcatgcagggcgggtttcgccactatatgaccttcgaacggaatatcccgaagtggagagaaaatatgaaggaactgccgaaggtcagcgtcctcatcccggcgcataacgaagaggttgtgattcggcagacgctgaaggccatggtcaacctttattatccgaaggaccggctggagattatcgtcgttaatgataattcatcagaccggacgggtgatatcgtcaatgaattttccgagaaatacgatttcatcaaaatggtgattacgaagccgccaaatgcaggaaaaggaaaatcctctgcacttaactcgggttttgccgaatcgaacggcgatgtgatctgtgtgtatgacgccgacaacacgcctgagaaaatggctgtgtattaccttgtgctcggcctgatgaatgacgaaaaggcaggcgccgtggtagggaaattccgcgtcatcaatgcggcaaagacgctgctgacgaggtttattaatatcgaaacgatctgttttcagtggatggcccagggaggcagatggaagtggttcaaaatcgccacgatcccaggcaccaacttcgcgatccgcagaagcattatcgaaaagctcggaggctgggatgacaaagcgctcgctgaggatactgagctgaccatccgggtatataatctcggctatcacatccgctttttccctgccgccatcacgtgggagcaggaaccggaaacatggaaggtatggtggcgccagcgcacccgatgggcgcgcggcaatcaatatgtcgtgctcaaatttttggcgcagttttttaagctgaaacgaaaacggattatctttgatttgttttattttttctttacgtacttcctgtttttctttggcgtgatcatgtcaaatgcgatttttgtagtgaatttgttttatgatttgcatttgtctgttggatttttggcaatgattctctggattttggcgtttttcttatttatgacagaggtcatgattacgttgagcattgaaaaaacagaaatgaacaagcaaaacttttttatcgtatttctcatgtacttcacatactcgcaggcatggattgtgcttgttatctactctttattcgtagaaatcaagcaccgtctattcaagcaagaggtcaaatggtacaagacagaacgatacaatcaacataaaagcgggtgacctttttgaaacaaataatcatttttctcacaagcttcatgctgctggcgatgactggacaaacggctcttgccaaagacctacaggtcagcggttcgctcctcgggaaaagcagccaagaacaagccaaacagcaggtgctgacaagcgagctgattacactgtatggatcaaaagacagcgcagagctgacgtatcagatcccggcaggcgcctcttcgggcaatcagcaattggtaatcgaatacgaggcatcaaatcttttaatttctccatcatcgttaacggctgtcattgatgatgaaccggtcaagacgttaaagcttgatggtgattccaaacggaaaacagtgaagctgaatctgaataaaagccagtctgcgcaaggctatcacaacgtatcgctgaaattctacggcgtaatgaaagagggcgtgtgcgtcagacaggatacatcaggcaactggatcaaaatttatccggacagccggctgacacttgctgacagcagtgaagcgaagggaacgtcgctggaccattatccgtatcctttcgcccaatctggaaatacagcggaagaaacagctatcgtcattccggataacccaagttcagcagaaatagaagctgctgttaaaacagaaggctatttgaaaacggtggacagcagtatcagtattgcgtatgtcacggaatctgaactgaaaaaaatcgataagccgacgattgttatcggcgtggacaagcattggaacggcaaagtgaaaaaactgttgaaacaagccgggctacaggcaaaaggagaaaaccttctgcttgcggagcgggtgctgaaagcagagggcaaacagcagccggttctgtttgcgcaagcggcgtccgaggacgcgctcactaaaaaaatcagcgtgatgacagatcagacatatacaggccagctcagcggcgatacactttcaatcagcaagcttcagcagactgaaaaaaaagaaagcgataagctgacccttgagaattttggagcgggtgatatcacaattggagccgacaaaacatcttcagcacattatttttatccggcttcggctgttttagatgaaaaccaatcggcgaagctgtcgcttaaactgaaaaagtctgaaacgattcaggcctcaacggctgaaaacgagtcagcctctcaggctgcagaactgaaagtgatgatcaacggccagccgcactcggtccggcttgatgaattaggaaaagaagataaaaacggattctatcatgtcaaagtgaaagtggaccctaagctgctgcaaaaaaaccgctacattgatattcagttcgtcacgaccggtttaaaggaaaacaacccttgtaacaccactgatgaagaaaagtgggtttttatcgataaaaacagtacattatcatacgccatcaaaggcatgtccccgtcagcggattttcaagagtggccgctgccttacgccggaaaccaggatcaaacaacgttaatcgtgcttcctgacaccgtaagccaatcgaagctagaggagctttctctcgtaacagaatcctttggcagcgaagcacagcattcatatacggtaaagaaatcatctgacgttacagcaaaggatgcgaaaggacgaaacctcattttcataggggggatcaatcaattttctcttctgaaggagaaatcatcagatctgcttgtgccgcaggaaaagaacggctcgtttgatgtatctagtttcgagatgctaaatgagacgacaaaacaagtggtatttacccaagcatcggtttgggattcacgctatacaatggctgtctttgcaccgtcaaaaggagatggcgcggctgtcacaaaagagatcatcagttatctgaacagcaacgatgagtcggcaaccgtccttaatgaaacaaatagccagcaggtgtttacaaaccaccagcagctcaaatcggaaacaaacagttccgatgcagaacaaccaacacaggatcatagccagaaatggatgtatattggtgtgctggcactcattatggtgattgcggcagtgttcatttggattgccgtaagacgcagaaaaagaaagacagatacagaataaaacagaggcgattttagcctctgttttttatttttggtaagtaaattccatttgtggaacctgtcattttatttttttctctcagccaataagcctctttacaacgtgcgggaacgggagtatgatctcttttagaaaacaaatcgcttaatctgaaatcagagcgggggacccaatagaacggctttttgccgttggggtgaatcctttttaggtagggctaactctcatatgcccgaatccgtcagctaacctcgtaagcgttcgtgagaggagatgaatgaaacctgtgttcgatgttatggcacaggggcatccgtttgcctctgtgttttttgttgttcatttttgaatgcaaatcgcatacagagacatcatagcagaaaggactatcatcaacatgtgagagcaagacactgatgttttattgttttaattgaaaaatgagaaattaaaaggggaagacatcgatgtatcattcaatcaaacgttttttgattgggaaaccactaaaatcccaagcagctggagagcaaaaactgacgaaattaaaagccttggctatgctttcctcagatgcgctgtcatctgtcgcatatgggacagaacaaattctaatcattttggcaacaatcagtgcagccgcattttggtactccattccgattgcggttggcgttctcatcttgctgctcgcactgattctttcatacaggcaaattatttacgcttatccgcagggcggcggggcgtatatcgtttctaaagaaaatctcggtgaaaaaccgggattgattgcgggcggttcattgcttgttgattatattttaacagtagcggtaagtatttccgcaggcacggatgccatcacgtcagcctttcctgcattgcatgattatcatgtgccgatcgctatttttctcgtgttagtgattatgattttgaacctgcgcgggctatcggaatcggcatcgattcttgcctatccggtttacctgtttgtggtggcgcttttggttctcattgcagtcgggttgtttaaactcatgacggggcaaattgaccagccagcccatcatacaccgctcggcacacctgtagccggcattacgctgtttttgctgcttaaggctttttcctccggatgctcagcgttgaccggggttgaggccatttctaatgcgattcctgcattcaaaaacccgcctgcgcgaaacgcggcaagaacgcttgcgatgatggggattttgctggcgattctgttttccggcatcacggttctcgcgtacgggtatggtacggcgccgaaacctgatgaaacagtggtttcacaaattgcgtccgaaacctttgggcggaatgtgttctactatgtcatccaaggtgtcacatcgcttattttggtccttgcggcaaatacgggattttcagccttcccgcagcttgccttcaacctggcgagagaccagtatatgccgcgaatgtttactgtcaggggcgaccgcttaggcttctcaaatgggattatctttttaggctttgcctccattgttctcattatcttattcggaggacagacggagcacttaatcccgttatatgctgtgggcgtatttattccatttacgctttcacaaaccggcatgtgcatgaaatggatcaagcaaaaaccaaaaggctggatcggaaaaatgctgatcaactcctgcggcgctctgatatcgtttatggttctatccattctgtttgtgacgaagtttaatgtcgtatggcctgtgttaatctttatgcctatcgtcgttttgctgttttttgcgattaaaaatcactatacagcggttggtgaacagcttcgcatcgtagacaaagagccggaagaaatcaaaggcaccgttgtgattgtgcctgtggccggtgtcaccaccgtcgtgcaaaaatcgattcactatgcgaaatcactgtccgatcaagtgatcgccgttcacgtgtcatttgacagagaacaggaaaagaaattcgaaaaacgctgggaagagcttaataacggagtgcgtctcgttacgcttcactcctcgtacagaagccttgtccatccgtttgataagtttttggaaacagttgaggcaaaagcgaagaaggagcagttttccgttatggtgctgtttccgcaatttataacgaaaaaacgctggcacaccatccttcacaaccaatcggccttcctcctcagagtccggctgttctggaaaaaggacataatggttgccacactgccgtatcattttaaaaagtaaagctctaggaccaagggaatcaccttggtccttttttgttggaaaaggaggtatggcggtgtatacacaaggtgcttttgtgatcgtattgaacgaaagtcagcaaattctgctgatgaaacgaaaagatgtccctctatgggatttgccgggcggcagggttgatcccggggaatcggcagtgcgggaggtattggaagaaacgggatacaatgtagcgctttctgcgaaaataggtgtttaccaaaggccaaagtttcaagatgaacagcatgtgtttttcggaagcataacaggcggacaagcagtggctgacggcacagagacagcgggattaaagtaggtttccccggagcgtttgccgctttttatggtgccgaaccgaaaaaggcagatcaatgatttcaagaatggcgctcaagatgtaaatgtcaccgtcaaggatagaggattgctcgcggcgatcgacctgttgaaaagaagactgggcaagcgataaaggtctccgggttttaaagcctttctcctgtggtattgaaaaaaggaaaaaggaggatacgttatggcacacaaaactgcaggacaagcaatgacagagctgcttgagcaatggggagttgatcacgtatacggcatccccggagacagtataaatgagtttattgaagaattaagacacgaaagaaatcaactgaagttcattcaaactcgccatgaagaggtagcggcactggcagccgcgtctgaagcaaaactcaccggcaagatcggagtctgtctgtcaatcgcagggccgggagcggtgcacttattaaatggtttatatgatgctaaagccgacggcgcccctgtgctggcgattgcaggacaggtttcttctggcgaagtcggacgggactatttccaggagatcaagctggagcaaatgtttgaggacgtggccgtgttcaacagagaggtacatagcgcggaatcacttccggatctcttaaatcaggcgatcaggaccgcctacagcaaaaaaggcgttgcggtattgagcgtgtcagatgatttgtttgcggagaaaatcaaacgggagcccgtgtatacttcaccagtgtatattgaagggaaccttgaaccgaaaaaagaacagctcgtcacctgcgcccaatatattaataacgctaagaagccgattatcctggcagggcagggaatgaaaaaggcgaaacgggagctcttagaatttgcggacaaagccgccgctccgatcgttgttacactcccggcaaagggtgttgttcccgataagcacccgcattttctcggcaacctcgggcaaatcggaacaaagccggcttacgaggcaatggaggaatgtgatttattaatcatgctcggaacgtcattcccataccgtgattatttgcctgatgacacgccggcgatacagctcgattcagacccggcgaaaatcggaaaacggtatccggtgacagcgggccttgtctgcgattcggctctcggcctgcgcgaattgacagagtatattgaacgcaaggaagacagaagattcctgaatgcctgcacagaacatatgcagcattggtggaacgaaattgaaaaagatgagacagaggcaacaacaccgcttaaacctcagcaggtcgtggcacgtcttcaggaagcggcagccgatgatgcggtgctctctgtagatgtcggcactgtgacagtctggatggcgcgtcatttcaaaatgaacgcgaaccaggatttcatcgtttccagctggcttgcgacaatgggctgcggcctgccgggagcgattgcagcaagcttgtccgaaccggaacgccaggcgatcgccgtctgcggtgacgggggattttccatggtcatgcaggaccttccgaccgccgtcaaatataagctcccgatcacagtcgtcattttaaacaacgaaaatctcggcatgattgagtacgagcagcaggtcaaaggcaatatcgactatgtcacaaaacttcaaaatgtcgactatgccgcatttgcagaaagctgcggagcaaagggcatcaaagtgaccaaagcggaagagcttgcgccggctttccatgaggcgctgcactctgaccaaccggtcgtagtggatgtcatgattggaaacgaaccgccgcttcctggcaaaatcacctacgggcaggcgaaaggctttagcaagtacatgctgaaaaacttcttcgaaaaccaaaaatttgaaatgccgtcactgaagaaaagtttgaaacggttattttagtgaatataactaagggttattgggataactcccaataacccttttaattaaattgaaaaacctatttttagatttagatgtcgactcataggatcatagatgtattgtaagaaagtgtttacatataaaaaaatgatatgttattatgtccttgtatttccatttttttaaaaaggaggaactataaggctaagtgtttcggtcgataaaaataagtataaggggaattagattatgaaaaaaaagttatttagtacaatttcaataggggtattaggagtaacattttttgcgaattcttatacaacgcaagctgcaccagagcatattaaacaggtaaaacatattgaattaaatactggtgaagatgaatacacaacaaaaaatgcatttgctgctggagttgctgccggtattgttagtgcagcagtttatgatggcattaaagccgctggaaattggttgggaaaacaagcaaacaaagctaatgcacaatctatatatagtgcagctcctgctagaaaatatgcatgttatatagtgaatcctcaagatcacaaggatattgatatttcagaagttgcggaatttggtaggtaaaaaggaaggggcctcccttccttttcaaatggaggttgtataatttgaagacaaagaggaaatataatttacttgttttgttcctttctttattagtagtattccatacaataataatgataatgtataacttgccgttaaatcctgttaactttaagcatgagaaattaatttcaacgtatatgaatccattatttactcaaaactggcaattatttgccccagatccggtaagcacaaataacaatattatctgcaggggggtctttacaaataataaaggacaaaaagaatatactgagtggatagatattacagaaagttataatgcagatattaaaaacaatttattttcaccaaacagattaatgaaaactgcgctttctggtgctgtctttgaggttcaaccgtatctaaagctgaatgataaaaagaagaataaacaattaattgagaacgaatacatccgaattatatctagtatagctgtgaaaaaaatagagagaagtaagaaagtaaaattagaatcattagatgttaagttgtctatagaatcgtttcctgagtatggaaagaaggggaagtcaaaatttaatgtacagcagttcccccatatcaatttactaacaaaggaatgagatttaatttgaaaattattttaaataagttcagaaattttaatcatttaatgtcaaataaaatgcattatttaataggttcaagcatcttaaggatatttattggattacatattatgtttacttatttaattcactttgctcaaaggaatgaaatatggggacctaatgctttttattcatttgaaaaatgctttgaagcttatggttttacttctctatatctttttagtgactcacagttatattttgagtttatttttataagtggaatagtcattaatactctgtatatattagggtataaaatgagaatagtcagcatcataaattttatttgggtttggtctttatatcaaaggaatccttatatacatgacggtggtaataatattcttattcttattatgttgtatcttatttttgcatccttaggtgagttttttactattcatactgaatcccgttcgaaagaaaagtctaaagttactattattattcacaatttctcagtgatgatttcaatgattcaagtgtctttactttatttttttgcgggctttaacaaagcgcaaggaaaaatgtggacccatgggaccgcactttactatatactacaggttgatgaatatagtataaacaaagggtttacaaatctcgttattgataacccttatcttctagtattaggaacatactcagcattgtttctccagctaatgtttccaatattagtttggaataggtattttaaaattcccctgcttataggttcaattctttttcatttatctataattatatttatgggtcttcttcaatttggtgttataatgatagcccttgatttattgtttataacggatacggagtataggaaattgtacaagtttttatcacgaatttatgataagtttaaactgaagtttaggaatattttcaaccaaaagttaagaaatcccaccatttaaaatatcgtttaaatgttaatgtcagactgttataatcattatgtcttttcaatccaatttagggggaaggggttttatgtttgattacattaagattattatttatttaatcggatcaattggaatgatctacgcttgttatcacgattataactatgcaaaaaaaggacaaaatgacaagtgcatatttttcaaaaataaacgattaagtggagtagtgctattttgttatttgtttttatttttagctaatcttaaggacttcttgtttttgttaattaacacgaaataaatacaattgtatagttaaaagactgtcgatgtgagtcggcagtcttaattttacctagtcaattattttcgtccttgtatgtttattcttatcaaatcttacagacttcttctcataatagggttatttttcttttttcttcagcccgaagaaaaaaggaaaagcagaaccgaccaagaaggtgccgaataaaaacatgccgccgataaacacgtggaaatttgtgtgtccggccgtaaacgccgtgattagggaaatgatactgagcacgatcatggcaatgccgggcgcgactctcatttttcccttggatttatgggcagcaacagaacataaaatgccgataacaataggaacaatccacaaataaaacagaataaatactgacatcatcaaaactccgatttttcttctatcataacaaatttctgtcaaaaagggtatcaatgagcttttgtgaaaaaataaaaaccggctttagaagccggtttttttatcgaaacgtatctacaattaaaaacacattcaaagcaacgatcaatacagcaatcagccaagacaccactgtgatccatttggcgttgatcagagatcccatgatccgtttattgcttgtaaacataataagcggaatgagggcaaaggcgatcccgaaggacagcacgacctggctcagtacgagagcggtcgtcggattaacacctgacgcgatgatcaagatcggcggaatgatcgtgataaaacgccgtacatacagcggaatgcggtagttgataaatccttgcataatcacgtcgcctgaaagtgtgccgacagacgaactggatagaccggcaacgagcagcccgatcccgaataaagccgcagacatagggctgacaagatgtccgaattgctgaaatgcgacgtcgagatcctcaacaaacaggccgtttttgaagaataatgcggcagccacaatcagcatacttgcattaatagcccctgcaatcagcatcgctattaaaatatcaataaattcaaatctaaagatttttttccgttctgcatcagttttgccaaccacccgccgctgtgtaagggcagagtgtaaataaatggcgtgcggcataacagttgcgccaagaatacccgctgcaagaagcacactgtcagtgccatgaaacgccgggacaaaaaggcccttcatcactgacacggcatcaggctttgcgaaaaaggtctgcagcgcaaaggcgatcacgaccacaaacagcataccagcaataccggcttcaagtgagcgataaccgcggcgctgaagctccaatatcgcgaaagaaccgatcgcagctataatagacgcttcaagcatcggaatgccgaacagcaaatacagtcccagagccgctccgataaattccgccagatcagttgcgataatgaccagctcgccctgaatccataatccgatcgagacaggcttcgggaattcttcacgggcaacctcaggcagatttttgcctgtcgcaataccgagtttggcggatagggattgaattaaaagggccatgatattagaaaataagatcacccataagagcatatatccgtatttagaacccgccgaaatattcgttgcgaagttgccgggatcaatataggcaatggctgctataaatgcagggccgagaaaagggagcagccctctgaatcctctgattttcccgtcaagcgcatcttggacggctttggaacggggagattgtgctgtgatgtccttgttcatcatgtctcacctgaattctgtttgtttttgccgtacaacaaagagtttccttaaggcaaattattttatctacatcatatgaccatcccggtttcttgtcaaccgaaaatgttcaaaatacacttctgaatttttccctgttatgtaacatgatatgtagggattcgggataaggtcccatataaaaagacatcgtttcagttcgaaacgatgccttctgtatctaatgagtctaggcttccttccgcagcccgcggaatataaggcccagcaagaatacgaagatggctgccccgatgatggccgggaaaatagcaaagccggcgaggctcggtccccatgtgccaagaagtccgtgcccaatccaagcgccgatcagcccggcaatcatagagccgaaaattcctcccggcagccggtttcctacaatggcgctcccaattaatccgataacaatagcaacaactaatgaaaccaaaaagctaagcatcatgatcacctctcataaatgatttaccaatcaataaccgctcctgatcatttcgaaacacctaaaagcatattcctttatgatcctgttttaatctttctctgcacactgccgtcagctaaatgaacaatgacctcagtgcctttatgcgccgcgatttcctttgcatccttgatttcagacacgcgtttggcgccctcggctttgactgcccagccttttttatgcttaataacatgttctgctttgttcatgagctcggagccgctgccgctgcttggatcagcatcgcgttctgtctcatcatcatgcgtcaggaaatcatcaatttcatctgtagaggcgttttccgcccattccttcgctttgcttgtcgcaattggaatcgcgcgcccttcctcatagccttcatcaatcatcgcattcgcaatgtctatcgccttttttctcaccggcttctcaagattttttaatgaagcaggataatccttcatcgaccaaggcatgtccatcactccttttccttttataaaaatggtacccgcaggtgaaaaataaaaacgcatccgaaaaaatgaaggtatactatatagtagaaaaaacggaagggaagtgcggattgggtgccaacagaacgaaaagaagacttacatcagcaattaaaagagatagagaaatgggaaaaagatcagcaaaaagtctggttttgggaaaagctcagccgtctcccgtttcagctgctggacaagctgacaccggaattcatccagaaaaagatcggcaagctcttggatgaggtcggcagctttgttcaaacaggcggacagtacctgacatctgaaaaacagattatcaggatgtttcaaaagaaactgccggaggagatctttgaatcgctggaggacgtccggaaagcgcctcttcctgtcatggatgaaattgcggaaggaatgggcaaaaacagaaccaacgcagcaaccgttcaaggcgcgacaaccggtgtgggcggcgtgtttacgctggcggcagacattccggcagtgcttggcttatcactaaaaacattacaggatatcgcagtcgcatacggctatgacccaaaggagaaaaaagaacgcgtcttcattgtgaaatgcctgcagctgacgtcggctgatgttgtcggcaaaagatcgattttgcaggaattaaaacactacgatcaagaccgtacatataagaatgtcgcttctcaaatccaaggctggcgagaagtcgttttgggctatcgagacacgtttggctggaaaaaacttttccagatggtgccggttgccggaatggtttttggcgccgctgccaatcgctcaacattaaacgacattaccgagacaggcatgatgctgtacaaaaagaggcgcattcttgaacgactgaaagaaacagaacgagagatggaatagtagaaagcagacggacaccgcgatccgcctgctttttttagtggaaacatacccaatgtgttttgtttgtttaaaagaattgtgagcgggaatacaacaaccaacaccaattaaaggaggaattcaaaatggcagacaataacaaaatgagcagagaagaagcaggtagaaaaggcggagaaacaacaagcaagaaccatgacaaagaattctatcaagagattggtcaaaaaggcggagaagccaccagcaaaaaccatgacaaagaattctatcaggaaatcggcgaaaaaggcggagaagccactagcaagaaccatgacaaagagttctatcaagaaatcggtgaaaaaggcggagaagtcactagcgaaaatcatgataaagaattctattaagaaatcggccgaaaaggcggagaggcaacaagcaaaaatcatgataaagaattctaccaagaaattggctcaaaaggcggaaacgcccgcaacaacgactaatcaaaagcataaaggcagacaacctgtaaataaaaaagcgatccggcacatcagctggatcgcttttttttggaatcttctcaatttatgccactattgcgatacaataagtgaaaaaggggttttcgctaatgtccaagatgcaaaacttgctcgccatcgcaaatgaagtcaaagaaaagcacgccaatttttcaatctcagaggtcaacgaccactgcgtgcgccttgcggtgtttacgggagaatatgactggcaccatcaccctgactcagacgaattgtttattgttcttgaaggggagctgctgatcgattttaaggacaaagaaaccgcggtgctcaaagcaaatgacagcctgctgatcccgaaaggcacggttcaccgcacacgctcttacgtcagaacggtaaatctctgtgtggagcataaacaagccaaaaccgtcatcatagaggagcagccatgctaatcaaaaagatgatatgtgaagtagacgctgcaaacgctgaagcatttgcaaaagcgcagtcacagtggggagcattatcgcatataagcggctttatcaaacaggccggcggctggcgaaaaacgatagacgagccgctcaccgcagaaatcatcagtgtatgggaaaacagagaagcctatgatcattttatggagaacgaacatgacagcatatacgaggaaaacgatcagaaggctgtaattctttcgatagaggtgacggtgtacgaagaggataaaccgttcgttcacgatctgttacataaccccgatatccggtacgaaccaaactggacggttctgaaggcataatcaaagcccaaaacatcatgttttgggcttgtctctttactcgcgtcccggaagtgtattatgaacataaggcggtgctggttttaactccggtttttctccaaacgtttttgcctctttcacatattcaaaggcttctccgtccggcgctttttcatttagccagttttgcttggcgctttcttcgccttcagagaaattgataagctgatgtgagaactcttgtttttcgagcgctttcgggaaggtacccggcacaaccggaccttcctgtgcttctaattctttaatggcggcaagccattgattctggtgcattgtgtcacgcgccagcaggaagctgagcatatctttgacgcctttgtcatccgtcatttcaaacaggcgtgcgacctgcagacggccctgtgattctgcattcaggttggcgcggaagtctgccagcaggtttccgcttgctacgatataaccgccgctccaaggtacgcctgtactgctttccggcatggcgccaagtcctgatacaatcgcatggtgagggttcatgccgcccaggatggagccgatgaccggatcttcagcagctttttcctgctgatcaagaggggcatcctcaagaagtctggcaatcatcgttgcgatcatttcaacatgcccgagctcctcagttgccgtatccatcagcaagtccttgtatttttcatttcctcttgtgttccagccttgaaataagtactgcatggcaactgaaatttctccgaattgcccgcctaaaatttcttgcatttttttagcgaataatggatctggacgatctggtttagcaggatgctgcagcatttttgtgtgcttaaacatgtacccatctcctttttcgtttatctctttttatatttccgatcaatagaaagataaacgaaaaacagcgtatcgagatgggaactatgaatcttttcgcagctccaacagttcccggatcagctcccggccaaagatgggctcatactgccgataaacagggtcaagacgcttcatccattcttgtttctctttatctgacagctcataaatatgtatagcagaattctttttgatttcttccagctgctccttgttcatttgttcggcatacgtttcattccactccgtcgtctccttcatcgcttcagtcaaaatgcgtcttgtttctggtgtttgcgccttccagaagtgttcatcagtcatgacagcgtagccgaggtaaccgtggctgcttattgtcaaatagtcctgaacattataaaattttttagaatagatgtttgaaattgtattttcttcgccatcgactacattgttttctaacagctgaaaggtagaattgaaggattcctgatgaggtgttgcgccaagcagcttgaactgatcctcaatcacatcgctttgcataatgcgcagatcctgcccttttaaatcatccggtgttttgaccggcccttgatttgttgtgatttgcttaaagccgttcgtccaataggccagtccttttaattgttttttctttagagaatcaaacagctgtgtgccgatgcttccgttcagcccttttttgacggcattgtaatctgtaaatgcatacggcagatcaagcactccccattcaggcgagagcatgccgagcttcgatgtggagggggcgataaattgaacatcgccgttttgcaatgcttcaatttcttcaatgtccgagtacaggcttccattcggaaatacttctatttttattttcccgcctgatttttcgttcaccagatcagcgaatttattggcggccagcccttttggcgtattttcagcaaccacgtggctgaatttaaacacgatttgatcctgcaggccttcctggtcgtcatcataaacaatctttttattgcctgtatgatcatggaatccgataaataaagcggttgcaattccagcgatcatcagtgcgagacatgcaagcaaactcttcatgaaaagccctcccctatgttaaggataatgggggcaatgacattcgtaaagacctgaaaggagaagctgatgaacaaaaagaagctctcaatccgttggaaaatcacgatcttatcctatatactcgtcattttctcctttttgatcggcggcattgtgctcatcggcaacattcagcatacagaggagcgggagctgaaaaagcggctgatgaatacggcccggacggtgtcagagatgacagaagtgaaagaagccttggcgcgaaaaaaacaaacagaagctgttcgccatgcggttgaaaaaatcaggatgattaatgaagcagactatattgtcgtcatggatatgaatcacatccgatatacgcatcctgtcagcacaagcattggcaagaaatcagaaggtgcagacgaggaggcagcgtttgcggagcacatttatttctctgaagcaaagggcgagatcggcacggcggttcgcgctttttatccggttaaggatcaagacttgaaccaaataggcgtggtgcttgtcggaaaaacgctgccggggatcgctgacatcctgcttcatttaaagcgtgatatcgcattcatcgttgtgctgacactcggcttcggccttgctggttcctttttgctggcccgccatatcaaaaaacaaatgtttcagcttgaaccccatgagattgtccgaatgtatgaagaacggacagcgacgtttcactcgatgaatgaaggggtgatcgccatagacaatcgtctcatcattacgattttcaatgaaaaagcgaaacagatctttgaagtgcagggggatctgatcggcaaggtgatttgggaggttctcaaggattcgcgcctgcccgaaatcgtggagcggaacaaagcggtttataatgaagaaattcgtgtcagcggaaaagtcatcatgagcagcagaattccgatcgtcatgaagaaaaaagtgatcggcgccgttgcgatttttcaggacagaacggaagcggccaagatggcagaggaattgactggtgtcagaaactttgtggaggcgctccgtgtccaaaaccatgagcatatgaataagctgcacacgatcgccggtctcatccagctggggaaatctgaaaaagccttgcagcttgcgttccaggcgtcaactgagcaggaaaatgtgactgaatttctgcaccgctcgattcaaaatgacgctgcggcaggccttctattaagtaaaatcagaaggggaagagagctcggcattgctgttcatatagatgaaaacagcagtcttcagcaatttcccgagcatgttgatcagcatgatattgtcgtgcttttggggaatctgattgaaaatgccttcggctcatttgaaaccgttcaatctgaagacaaacgaattgacattagtatcgaacaaacggatgatatccttgctattttaatagaagataacggctgcggaattgatccggcacatatgcctcgcctttacgacaaaggttttacggtcaataaaactggcggcacaggctatggcctgtatctagtgaaacaaatcatagacaaaggatcgggcacgatagaagttgattcacatgcggggcaggggacatctttttctatcgtttttccaatgaagggggaggaagcacagcatggctcgtaaagaatggaaggttctgctcattgaagacgatccgatggttcaagaggtcaataaggatttcattacaactgttaaaggcgttactgtctgtgcaacggcaggaaacggagaggaaggcatgaagctgattaaagaagaacagccggatctcgtcattctcgatgtgtacatgccgaaaaaagacggcatcaagaccttgcaggagatcagaaagcaaaagcttgaagtggatgtcattgtcgtctccgctgcaaaagacaaggaaacgatctcactcatgctgcaaaacggagcgattgactatatcttaaagccgtttaagcttgagcgaatgagacaggcgctcgaaaagtacaagcaatataaacaaaaaatcgaagcgaatgatacgctgtcccaggaacagctcgatgcgatcctgaatattccgcagcaggccgtacaggatctgccgaaagggttgaatcacttcacgatgaatgaagtcactgcttttttgaaacagcaaaccgcatccctttctgctgaagaggtcgccaaggcgctcggcatcgccagagtgacagccagacgatatcttgattacttagaaaaaaccgggatcatcaaattggacgttcaatacggcggagtcggccggccggtcaaccgctacgtgttaaaaggataaacctgagaccaaaaagaccaaaatgtccgttatgatcataaacttccccagacgttatgaaaacgctatcattctagtgagaaagacacaaaaggcgaataggacagggggatgaaggatatgaaactgtttaaaaatttaacagttcaggtcataaccgcggtcatcatcggggtcattgtcgggctggtctggccggatgtcggcaaagaaatgaaaccgcttggcgatacatttatcaacgctgttaaaatggtgatcgcaccaatcattttcttcacaatcgttctcgggattgcaaaaatgggcgatatgaagaaggttggaaaagtagggggaaaagcgtttatctatttcgaggttgtcactaccctcgcactcattatcggtttatttgtcgtcaatattatgaagccgggtgcgggtcttgattacagcaagcttgaaaagggagatgtatcacaatacacgcaaaatggcggtcagggaatcgactggattgaatttgttacacacattgttccatccaacatggttgatgccttcgcaaaaggggacattttgcaggtcttattcttttctattcttttcggagtgggtcttgcggcattaggtgaaaaaggaaaaagcgtcattgatttcttcgacaaggtttctcacgtttttttcaaaattatcggctacattatgcgcgccgcgccaatcggggcattcggggcgatggcgtatacaatcggacacttcgggctcgattccatcaaaccgctggcaagcttaatgatgtctgtttatattacgatgttcctgttcgtatttgttgctttaaatatcatctgcaagctttacggattcagcctgtggaattaccttcgcttcattaaggatgagcttctgatcgtgcttggcacaagctcttccgaatcggtgcttccgcgtatgatggataaaatggagcgctacggctgttccaaatcagttgtcgggctagttattccgacgggctattcgtttaacctcgacggcacatccatttatttatcaatggcgactgtctttttggcacaggtgtttggagtagacctcagcatcggccagcaaattacgattatcctcgttctgatgctgacatcgaagggagcggcaggtgtgacgggaagcggatttatcgtccttgcctcaacgctgtcagcgctgcaggtcattccgctggaggggcttgcactcctgctcggggtcgaccgtttcatgagtgaaggaagagccattgtgaacctgattggaaacggaatcgccacgatcattgttgccaaaagcgaaaatgaatttgatgaagcaaaaagcgtagaggctgttgaaggcatgaaaaaaatgaaaacagcagtctgaaaaaagaacggcccatccatggggccgtttttttaattgtttaagaattattaaggtaaggacagagacctcagcatttttttgttatataatttacaaatggatactatattgaatgaaggacgtttgtcctaacaggagtgtataaatggccgctttagttaaattttttcagcacccgggagtaaggcgtttctccatctttgtcgtgttaactggtgtgttatatctatttaagagcatgattaacttaatattgcttaccttcattttcacatttctaatggatcgtttggagcttgtcgtgcggcagtttgtaagccagttcttccgcgtgagccagcgggttgtcattacgtttctttacatgttgctggctgtgctgcttacagtcgggggctttgtgttttatccggtcgtcgccgcacagatccagcagctggttaagcagattaaacatattgcgtatcaccctgacagcatccctttctttgatgagatcaccagtgtcttcggagatattaacatcagttcatatgtcaaagagggcttcaatgtagtgtatacgtatctggccgatatcagcacattcggcttgcaggtcgtgatggcgctcattctcagcatgtttttcttatttgagaaaaaacggctttctgaattcatggcgaaatttaaaacgagcaaactgagggtcttttatgaggaaattgcttttttcggaagcaaatttgcaagaacgttcggcaaggtgctcgaggctcaatttatcattgcgctcgtcaactgtattctgacgtttatcgcgctttggattatgcattttccgcagctgtttgggctttcgattatggtgttcttccttgggttgatccctgtagcaggcgtcgtcatttccctgattccgctcagcattatcgcctacagcactggcggcggaatgtatgtgctctacattgtccttgtcatattcgccattcatgcgatcgaaacatatttcttaaatccgaagctgatgtcggcgaaaacagagctgccaatctttttcaccttcactgtactcattttttctgaacactttttcggcatttggggtttaattatcgggattccgatctttgtgtttctccttgatattctggatgtcaccaacaaggaagataggtctaaaggaccccgagagaatagcgataaaaagtagtttaaaatcgaataatgagtgtgcctcgatctgccggcctgcctgttcagggcatgagattaagattcggaatcggcgcttgatattgcttcgcacagtggtgaacacaacaggtgacaatgcctgtcatcagtacagaaactgaaaagaacaaacagtcggagcaaacgctcatcatcggtttaaccaaacatttggaagcaacaaatgctataatacaaacagtgcctaatgttgggcactgtttattttttgtcgaaaaaggaggaaggctttatggctgagccgattttacatattgaaggcctcgataaaaagattgggtctaaacagattttaaaacagatcagcatggacgtcatggaaggtgaaatcatcggccttctcggtccgaatggttccggaaaaacaacactcatccgtatcatcgtcgggctgttgaaacaaaacagcggaagcgtgacaatcagcggattccagcatgatacagagtttgaaaaagcgatggaagcggttggagcgatcgttgagaaccctgagttctatccgtacctgacaggctgggaaaacctcaagcactttgcgaatatgcacaaaaaaatagcggatgaacggcttgatgaagtggtggagcgtgtcgggctgacgtcagcgattcatgataaggtgaaaacctattcccttgggatgcgccagcgtctgggaatcgcccaggcaattcttcaccggccgaagcttctcattctagatgaaccgacaaacggcctggatcctgcggggatgaaggattttcgcgatcatattaaagagctcgcagaaatggaaggaacagctgtcctgttcgccactcatttattgcgggaggttgaagacttgtgcgaccgtgtcatcatcattcaaaaaggtgagatcaaagcggaagtcagcttacaaggaactgatcaaaccacagaaaaagcgattatagaagtgcagccgcaagaaaaagcgctcaattggctgacaggcaatcaatatcaagctgagagccaagacgggacgattgtagttgaggtggcaaaagaaaacataccggagctgaaccgatcacttgtcggacaaggtctgaatgtattttccattaccccttacacacagtcactggaagacgaatttataaaagcgacaacagctcatcaagaggagggagaagagcttgtctaaattgatttggaatgaacatatgaaactttttaatcggaaggtcactttggtttcccttatcctgatggctgtctttcaattcttcatggcattgatcattaaacggattgtcatcagtgccggaacagatgaaaacttcatcggctatttatcgtatacaccgagcctgaacattttgctgcaggctttaacgatcgtaattgcagcaacaattgtttcgatggaatttgataaaaagacgatcaaatttttgctcattcgtccggttaaacgccaaaaggtcttttggtcaaaattaatcacagtcgtgatggtcagcttctatttgtatctggcatactacattctcgcattattattcggtctcgtgttttttggcacatcggtgactgcggaatcaaagacattgctggtcaacaccttggcgctgatcgggtcaaactggcttgaagctgtaatgatgggattattcgggctgctttgttcttcgctgttccgcaacagcgcggtagcagttgttgtttcttttgtcgttttatacggagcgagtacacttgttcagctcatgaagttgtttgaaaacaagtggggcagctttttgctttttgcgaacactgactttacgcaatacagaagcggagagacagcgttgttttcaggcatgacgccattgttttcaattggaattctcatcatacatgccatattcttcatcgttgttggctggtggtgcttctgtaaacgggatgttcgggtctaaaggcaaggaatgacatttttgtgaaaaagctcacgtaaatcaatatcatttgatattttggtttatactaaaggtactgacggaggtgtctcgattgaggaactttattaccgctttaccgatcgtattgctgcttggattctcatttgtgtcattcatgtttcagtttgaacatcttgtttatttcaggctcgcgcttgggttgttttctctcgtgggactgtacatgatatataaaatgaagacgggcatccgctattttatcatctatctgtatgccagctggattgtgttggccgcagtgaccgcttttgaagagccgattttctcaagctttttctttggcggcctggtgatgacgatgggttacctgacatatatgctgatttatctcggcatgaaacaagaccgggatgcaaatcctgtgtaatcgcgctgttcccttggggaacggcgtgtttttctatactggacaaaaagattaacagttgcggaaaaatggcaggaaatctataatacatattaaatttatcggaattaaaacttggggggctgccggatgtcattatttatacaaaacgatcaacagcggcaatggatggagaaaatcggacggattgcggatgaatttcagcaaacagctgctgaagatgacgaacagggacgttttcctgcagagaaaatacaaaaactgcgtgatgctgggtatacagcattaacattgccggcatctcatggcggagggggcatttctgtttacgatatgctcctgtttcaagaacggcttgcacggggagatgctccgacggctcttagcatcggctggcatttgagcgtgatcggggagcttggagaaggcaacagctgggatgaagacgtatttgcatttgttgccaaggaagtccagaacggagctgtcattaacagggcggcgactgaagcgaaaaccggaagcccgacaagaggagggcgtcccggtacacacgccgtcaaaaaggatggcaaatgggcagtgaacgggagaaaaacctttacgacgatgtctcaagcactggattattttttagtaaccgcatggattgaagacaaacaaacaacaggcgtgtttctcattcataaagatgatcacggcttgtcgattgaagaaacgtgggatatgatggcgatgcgggcgactgggagccatgaccttgtactgaacgaagtcatgcttgatgagaataagctggtggaactgcttcaagggcctcgcggagctaagccgaatggctggctgcttcacattccagcgatctatcttggtgttgctcaagctgctcgtgactatgcagtgcaatttgcatctgagtattctccaaacagcttgaatggaccgatcaagaatgtcccggccgtacagcaaagaacaggcgaaatggagcttgaactgctcaatgccagacactttcttttccatatcgctcaattgtatgacgatccggagcggcgtccacacttgacaagcgagctcggtgcggctaagcatatcgtcacaaacgctgcgctgtctgttgttgataaagcgatgagaattgtcggggccaaaagcctggaacgaaccaacccgcttcagcgctattaccgtgatgtgcgcgccggtcttcacaacccgccgatggatgacgccgtgatacacaagctggcggctgaagcgtttgagtgataaaaaaaagagccttaccggctctttttatgtattgttttgctcctgcagatttttttgatgcttgcggtcgatcctgtcataaataacgttcatcagctttggattgcccataatcgcctctttgttttcctggatcagctgttggtaagttttcactttacgcttcggcatgctccggcgccctcctgacatggttgtattcactttctaactccgtcagcgacaattcatacagatgacgctttgactttttgtatataccattctgtattaacagatgaatgagctgtttttttctgatttctgcagactgaggtgtcattgtgtcaccaacctccaatcaaacgatattgataatcattatcaattaacttcagtatacattgtccgcaatcgcctgtaaagatgaaaacagtcctattcttggccaatttacaaacattcaacaaatcgacaaaaagtttcccgggcaataatttgctgtcgaaatattccgcttcattgaacgcgtcctgctatttttcatgttttgaaccatactatgtaatagaatggaggctggtattcaatggagcggacagaaaatctgaaaaagggagaaaaaggggcgctcctcaatatttttgcatatgtcatccttgctgttgtaaagctagtcatcgggattctatatcattctgaagcgctgagagcagacgggttaaataatggaacagatattgttgcgtcagtagcagtgctgataggattgcggatttctcaaagaccggctgacagcgatcatccatacggccattatcgggctgaaacaatttcgtctcttgttgcgtcttttattatgatggcagtcggcattgaagtgttaatcggcggaggaaaagcgattgcgggcggcacaacggaaacgccaaatcttatcgcggcatggacggcgttaggcagtgctgtgtttatgtatggcatctatttatataacaaaaggctggcggcgtccattaaaagctctgccctgatggcagcggcaaaggacagcaggtcagacgcttttgtaagtgccggcgcgtttatcggtgttttttcgtcccagctgaagctgccgtggattgatccggtaacggcttttatcatcggcatcatcatttgcaaaactgcgtgggatatctttaaagacgcttcacattccttaacagacggtttctatttaaaagatcttgagccttacaaacagaccgtcggcaggatcgaaaatgtgcatcgtctaaaggatgtgaaagcgaggtatttaggcagtacagttcatatcgagatggtgattacggttgatccgaagcttacagtagaagaaggccatggagtggcggatgaagtagaagacaaaataaaacatgaacacgatgtcactcatgttcatgttcatgtagagcctgacgacataaaataaggctgtttaacgaattagcttatatgttcagataaaaattcagtcacttcttcaggcgttttggcattggcgctgtgaaggtgagctgttttttcaccgttcttaaaaataagcaggctgggaatgcccattacttggtatttttcagccaggtcaggaagctcgtccttattcagctcataccaatcgttttgattgtattcttccaaaatatcgccgatgaacatattcatgcgtgtgcagtctgggcaccaatcagcataaaactttacaatgatttctttatcggattgaatcagttcattaaattgttcgtttgttgtgatttttttcatatgtcacatctccttttcaatgccattttaatataaaataaaaaggaattacatacaaatgcattcaacatcagcatgcccaaaaataattagatcattttccggtgaaaatgataagatagtaaagatgaattgtagtggggggagtatccattgaaaacaagtctaggattagtgtacggaggaaagtcggcagaacataatgtttccctgcagacggctctggctgtaatcaaagcgctaaatactgagaagtttgatatacatccgatttatataacagaaaaaggcgaatgggtaagaggcgcccgtttaactgagcctgtttcaaatgtgaaaatgcttcaatttgagcaaggaggcagtgctttttctccagctgccttgaaccaggagatgtttccgcaggaagcgtcacagcaaaatgaagccatcgacgtcgtattcccgctcctccacggaccgaatggagaagacggtacgatccagggaatgctcgagctgttgaacattccttatgtcggcaacggagtgcttgcttcctcagctggcatggataaagttgtcatgaaacatttatttgcgcaggctggccttgctcaggctaaatacgcagctttccttaagaaagactggactcgttcttcgaaagaatgctgcgagcaggttgaacaggaattaggctacccttgcttcgtaaaaccggctaacctcggctcaagtgtcggaatcagcaaatgccgaaaccgtgaagaactgcaaaaagcgtttgagcttgctttccaatatgaccgcaaagtcgtcgtcgaagaaggcattaacggccgcgagatcgaaatcggcgttcttggaaatgacgatcctaaatgctctgttgtgggagaaatcgcaccgaagacagatttctacgattacaaagcgaaatatgaggatggagatactgatctgatgattccggcgattgtgtctgatgaggagtacgcaacaatcagtgatatggcgatcaaagcgtttaaagcgatcgacggttcaggactcgtcagagcggactttttcctgacagctgacggcgaagttctgatcaatgaagtcaacacaatgcctggctttacacctttcagcatgttcccgctgctctggaaagaagccggagtggaatatgctgacctgattgaacagcttgtggagcttgcaaaagaacgccacgctgaaaaacaattgattaagcatacattctaatgaagaaggacactgccggtaaaagggcagtgttttttcccgtatatacaaaagaaagagagggaccttacttgattaagcgaacagtaaaaaacattgccgaaatggttaaaggcacactaacaaatccgcaatatgaacaaacagtcattcatggagtggcaaccgatacaagaaaactggaacaacatcagctcttcattccgctgaaaggggaacgttttgacggccacacttttgtggaacaggcttttgaagctggtgtagcggctgttctttgggatcggtcagaaccaaatccgcccgagaatcacgccgtcattttagtggacgatacccttaccgcacttcagcagcttgcaaaagcctatttgcaggagcttggcacgcgtgtcatcggagtaactggaagcaatggcaaaacgacaacaaaagatatgattcacgccgtactggggaccaagtaccgtgtccacaaaactggaggaaacttcaataatcatatcggtttgccgctgacagttttagcgatgcctgaaaatacggagatcgccgtattggagatgggaatgagcgccaaaggagaaattgacctcttgagccgcctggcaaacccggatgcggcagtgattacgaatatcggcgaatcgcatatgcaagacctcggctctagagagggcatcgcggaggcgaagcttgaaatcattaacgggcttaaagaagacggagtgctgatttatatcggggacgaaccgcttcttcaaaatgcatacagctgccagacgaaaacgtacgggacgggagcgcataatgattatcagcttcaggatgtcagccagagtgaggaaggaacccattttacaatcaaagggatagaaaacacgttttttattccgatactcggcaagcacaatgtgatgaacgccatggcagcgattgctgcaggggcttattttggcatcgcgcctgaggatgcggcaaaaggactgagcggcctaaaggtaaccgggatgagacttgaactcatcaaaacagaaagcggcctttcgataatcaatgacgcttataatgcgagcccgacttccatgaaagctgcaattcaattgacagaaagcctcgaaggctacggcaaaaaaatgctcgtgctcggtgatatgcttgagctcggcgatcttgaagaaacgttccataaagagtgcggcgctgtgatcagccctgagagaattgaccgcgtctttacgtacggaaaactgggagcttttatcgcggaaggcgccctgaaacactttgagaaagaccgcgtcagccattacactgagaaaaaagatctcctccaagctgtgaaggaaaacgcatcaaaaggcgatttgattttattcaaagcgtccagaggtatgaagcttgaagaaatcgttaaagatttaatagagagcccgctttcataagaaaatattttgcgaaaaaacgcatattgcatcataaaataacatgatatgcaaacactaatgtatgccggccgaaaattatgtatatctggccggctgcggctatgatacaatatatatataggttatttcgcgatacgaacatattcgtccggacttttcatcgtgacccgaagttctccgctggattcttgggagcggatggagcagcagccggcatattcgagatgccgatctgcttctcatcttattgaaaaacaaatagtgtaatggtaagataaaacttaaagtaattcgggctttgtatacggatggatcctgtccttcttgtctaaagggcagttttataagtggtaaatcacgacattactgaaacagcaattagaaggagtttgaataatttgactataacgtttcaagattttaatttaagttctgatctcatgaaagcaattaatcgtatgggatttgaagaagcaacaccgattcaggcacaaacgataccgctcggactttcaaataaagacgtcattggacaagcgcaaacaggtacaggtaaaacagctgcgtttggtataccccttgttgaaaaaattaaccccgagtctcctaatattcaagcaatcgtaatcgcgccaacccgtgaattagccattcaagtatctgaagaattgtataaaatcggacaagataaacgtgcgaaggttcttcctatttacggcggacaggatattggacggcaaatccgggcgttaaagaagaatccgaatattattgtcggaacacctggccgtcttcttgaccacatcaaccgccgcacaattcgtttaaacaacgtaaataccgttgtaatggatgaagcggatgaaatgctgaacatgggattcattgacgatattgaatctatcctttcaaacgtgccaagcgagcatcagacacttctgttctctgccacaatgcctgcgccgatcaaacgcattgcagagcgcttcatgactgagccggaacacgtaaaagtaaaagcgaaagaaatgacggtttctaacattcagcagttctatttggaagtgcaagaacgcaaaaaattcgatacactgactcgtcttcttgacattcagtctcctgagcttgcgatcgtattcggacgtacaaaacgccgtgtcgatgaactggctgaagccctgaaccttcgcggatatgcagctgaaggtattcacggtgacttaacgcaggcgaaacgtatggttgcgcttcgtaaatttaaagaaggcgcaatcgaagttctagtcgcaactgatgttgcagctcgcggacttgatatctcaggtgttacacacgtatacaacttcgacgtgcctcaagatcctgaaagctacgttcaccgtatcggaagaacgggccgtgcaggaaaaacaggtatggcgatgacgttcattacaccgcgtgagaaaagcatgcttcgcgcaattgaacaaacaacaaaacgcaaaatggaccgcatgaaggagcctacacttgatgaagcgttagaaggccagcagcaggttactgttgaacgtcttcgcacaacaatcagtgaaaacaacctgaacttctacatgacagcggcagctgagctgcttgaagatcatgatgcagtaacagtggttgcggcggctatcaaaatggctacaaaagagccagacgacacaccggttcgcttaacagacgaagcgccgatggtcagcaaacgctacaagaaccagcgctcttctaaacgcagagacggtcaaggcggcggctaccgcggcggaaaagggaaaagcaacaaccgttcttcctatgacaaaaagcgttcaaacgatcgccgttcttcaggtgacagacgccagaaaaaatcttactaatttgatcgattcagagcccaaaacatgatgttttgggtttttttatgttcgcgatttgttattcagcaaactttcagctgacggaagccatttttctctgtatgcttaagaatgaaacctttctgtaaaagagacgtataagtaacgacgaaaaaaagggaggtaggtatttttgagagagcagccaaaaaaccaaatcagtccagacggattaaaggtttggcgacttcaagagatcatcatatccgctgtttgcttgcttattgtcattgcagttgcagtgttaagctattattttcattggccgtactggatcagcggcgtgctcggcgcagtttggctgctgggatcgattgtgacggtctttatcattccgaaggtccgtcataaggtgtggcgatatgaagtccatgaacatgaaatagatattcagtcaggtatttttgtggtgacacgtgtgattgttccgatggtcagagttcagcacgtcgatacgtcacaagggccattattaaaaaaatacaacctggcaacggtgaaaatttccacggccgcgaccgttcattcgatccccgctttagagatggaggaagcggatcggctgagagactccatttcccgtctggcgagggtgactgacgatgatgtctgaaccgaaacgcctgcacccggcagcagtcattttgaatttatgccataccattattcaaacgataaaaaatatcattctgccattcttttttgtgtatattgtcaattcaaaccatactgtccgtttttacggagccattgcgctcggtgtgctgttcatctggcttgtagcggcaagcattatcaaatggagaaggtttacctatcgaattgaagatgatgaatttagaatcgaagaaggcttatttgttacgaaaaagcgatacatatcgattgatcggattcaaacaatgaatacgagtgcgggccttgtccagcaaatctttaagcttgtgaagctgcaaattgaaacagcaggcggaggcaaggaggcagaagccgttctttctgctatttctgttgaagaagcggaacgcatcaaagaagctgtctttaagaaaaaagcgcaaagacgagaaaatgaacttgatgaagaacggcttgaagctgaagaggagttggttccggccgttgaggtgcaagagcactatcgcatgaacgcgaaagaattgctcatggccgcttctacctccggcggaatcggagtcattatctccgctgtatttgcacttatttcccagcttgatgaagtgctgccaatggattggttatttgataaattttccttccttcagcacgccagcatcggtatttacgcggtactgatttttatcggtttatttatcgcctggattttcagcatcgcgggcatgatgtttagatacgcgaactttcaaatcataaaaaaagagcaggaacttgtgatttcaaggggaattattgaaaaacatcaagtcacgattccattgcgaaaaatacaagccattaaaatcaaagaaaatatcattcgccagcttttcggctttgtaacggtgtccatcgtcagcgcaggaggcggcgaccgggaaaaagaagaaggcgctttgaccattctctttccaatgattcataaaaaaaagcttccgcacatgctccgaacatttacgccggaatatacgctggaagaaaactgccgccgcctgccgcggcgcgcgttgaaacgctatttgttccgttctgtcattttttcactctttttgatcattccgttatgtatcttctttcagccatggggctatctgtcagccatcctgctgccgatagagttgctcttcggctatctcgcgtataaagaggctgcatggacgatcaacggggaccgtcttcagctgacgtctagatttataggcagaacaaccgccattgtactgaaaaaacgaatgcaggtctgcaagttcagccaatcctatttccaaaagaaaggccgcttgtataccatttctacttcggtgaaatcatcgagccatatggaagaattaacggtgagggatgtaggtgaagaggatgcagccttcattttaaactggtactcatatgaaaaagcggacggttaataccgccgctccagcgtgtcggcaaaccctcgcattcgttgtcaggactgcgcttcggtgctcacgaatgagaacattcgctccgctcctatgctcgtccttcctagacttcaagggttttcaatcacgctgaaaagatgacaaaatcctaaaatgaaaaccattttaggattttgtcaacaatctgaagcgacggttaataccgccgctcttttttttgcacgcataaaaacgaaagaagaagcccgccgcatagtccaaacagatgggccatcatgttaatattggagttgataaacgacatgagaacggcaaatgcgagcagtgtgatgatcattttggaatgctcctgccctattagctcattgcgaaaaagaaccataaacaggtacacgccgaatagcccgaaaattgcgcctgaagcaccgacatgcacgtaatcaagcggctctgtaatataagtgccgatattgccgatgatgccggagccggcgtatacaagaaggaaacgcgcttttcccagcatgcgttccaaagccggggcaaataaaaagatggacatggaattaaacagcagatgtgtgaaaccggcgtgcagcaaaattggtgtgatcagccgccaccattcaccgtttgcgacacctagattatagcctgtgacggtatccctccataacacgactgaatgggcaggaagtgaaaaaaacagccagagaacagcttgcaaagccaatataaaggtgacaacggggtaaagcctgataaacgtttgaaaattttcagtccgtataaacattccgagccccttttcttcattttggtatatctatagtaacacgtttatgagacaaaccatttaaatagtacgtacgcaaaggaggttatcatacatgatttacggcattgggctggacattaccgagcttaaacggatcgcctctatggctggacgccagaaaaggtttgccgagcggattttgacgcgaagcgagcttgaccaataccatgagctttctgagaaaagaaaaatcgaatttctcgcgggcagattcgcggcaaaagaagctttctcgaaagcatttggcaccggcattgggaggcagctcagctttcaggacattgaaattaggaaagaccaaaatggcaagccctatatcatttgcacgaaactgagccaggctgccgttcacgtatcgatcactcatacaaaagaatacgctgccgcgcaggttgtgattgaaaggttgtcaagctagtctgcatattagggaaaccccactcatatatttgatagtgcattaagggagacaagttgtttgaggcttttatggtacgcatctgttctgcctaaacgtgtaccgagcgtaccgttaaagtcaaacaagcgatttcttccttttacatcaattgagaaaaaggggttgaaaaaggtgagaaaaagctttgttttgcttttaacgggactgcttgctgttcttattctttctgcctgcgggcaaaaaacacagcaagatattgtggccgggttagatgaaaaggcgaaagaatacacctcgtacaaagcaaaagcgaaaatgaccatcgagacagggagtgagcctcaagtatacaatgtggaaatctggcacaaaaagccgtctctgtacagggtttatttagaaaatccgaaaaaggaccaaaatcaagtcattttacgaaatgaaaacggagtattcgttctcacgccgtctttaaataagagcttcagatttcaaagcgattggccaaacaacagcagccaggtttatctgtttgaatcgctcgtaaaggatgttcaaaacgattcggatgcagttttcacagcgaaagaaaagaaatacgtattcgaaacaaaaacaaactatcagcataacaaaatgctgccgacgcaagaaatcacatttaacaaaaaagatatgagcccgtcatctgtcaaagtgatggataccgaccggaaagtgatggtcaaagtagaattcagcagctttgaatttaataaacaatttgataaagaatcatttgatgaaaagaaaaatatgaccctttctcaaatggatgtcgccacaagcgcgaagccttccgatacatttgcggtcaaaacgccgctggaactgccgcttggcgtcaagctgcttgaagaaaaagatatatctactgaagacgggaagcgcatcatcatgacgtacggaggagaaaaatcatttacgttaattcaggaaaaagcccagattgccaaggcttcctcctccgttacgctgaacggcgaaccggtaaatctcggctacaccatcggcgccctgtcggatgcatcattatcatggacatatgacggcgtagattaccttctctcttctaaagatctttctaaagaggaaatggtgacagtagcgaaaagcatgcagggacaatcatcgaaataaccgccaaaggccaaacatgatttggcctttttttcgttagacatcgtttccctttagcctttaattttagtatgatatgtaaatgatattgaataaaagctaggaagtgtcgtaatgagcacaaaacctttttacagagatacgtgggcggaaattgacttgtccgcgataaaggaaaatgtcagcaatatgaaaaaacatatcggtgaacatgtccacctgatggcagttgtgaaagcaaacgcctacgggcatggtgatgcagaaacagcaaaggctgctcttgacgcaggtgcttcatgcttggcggtggccattttggatgaagcgatttcactgcgcaaaaagggcttgaaggcacctatattggtgcttggcgcggttcccccggagtatgtggcaatcgctgccgagtatgacgtgaccttaacgggttattctgttgaatggcttcaggaggcagcccgccacacgaaaaaaggttctcttcattttcatctgaaggtcgatacggggatgaacaggcttggtgtaaaaacagaggaagaagttcagaacgtgatggccattcttgaccgcaaccctcgtttaaagtgcaaaggggtatttacccattttgcgacagcggatgaaaaagaaagaggctatttcttaatgcagtttgagcgttttaaagagctgattgctccgctgccgttaaagaatctgatggtccactgcgcgaacagcgccgccggactccggctgaaaaaaggcttttttaatgcagtcagattcggcatcggcatgtatggccttcgcccgtctgctgacatttcggacgagataccgtttcagctgcgtccggcatttaccctgcattcgacgctgtcacatgtcaaactgatcagaaaaggcgagagcgtcagctacggagccgagtacacagcagaaaaagacacatggatcgggacggtgcctgtaggctatgcggacggctggctccgacaattgaaagggactgacatccttgtgaagggaaaacgcttgaaaattgccggcagaatttgcatggaccaatttatggtggagctggatcaggaatatccgccgggcacaaaagtcacattaataggccggcaggggatgaatatatttccatggatgagattgcaggaaggctcgaaaccattaactatgaggtggcctgtacaataagttcccgtgttccccgtatgtttttggaaaatgggagtataatggaagtaagaaatcctttattgcaggtaaatacaagcaattaacttacctaaatggagaattcataaaacagctttgcttgaagagtgaataatggtatcattatcactggatggataaaagagtcgtatccgtaagtttggtggaggtgtatgttttttgtctgaatccagcgcaagaaccgaaatgaaaatcagcttgcccgaaaacctagtagctgaattggatggtgtagcgatgcgggagaaacgaagcagaaacgaactgatatcacaagcagtgagagcgtatgtcagcgaacgaacaactcgtcacaaccgtgatttgatgagacgcggctatatggaaatggcgaaaatcaacctgaatatttcttctgaggctcactttgcggagtgcgaggctgaaacgacagttgagcgcttagtcagcggaggataatcatttgattgtgaaacgcggcgatgtttattttgctgatttatctcctgttgttggctcagagcaaggcggggtgcgcccggttttagtgatccaaaatgacatcggaaatcgcttcagcccaactgctattgttgcagccataacagcacaaatacagaaagcgaaattaccaacccacgtcgaaatcgatgcaaaacgctacggttttgaaagagattccgttattttgctggagcaaattcggacgattgacaagcaaaggttaacggataagattactcatctggatgatgaaatgatggataaggttgatgaagccttacaaatcagtttggcactcattgatttttagacatatttgcaggttgctcaaatagagcaactttttttgttttcaaaaaacataaacgatataatagtgaaataacgaaaaaatatgttgttttttattgggaggtaagcgaatttgatgtcgaatcagactgtataccagttcattgccgaaaatcaaaatgaactgctccaactgtggactgacacactaaaagaattaagcgagcaagaatcctatcagctgactgaccaagtgtatgaaaatatatctaaagaatatatcgacattctgctgctgtctgttaaggacgaaaacgctgctgaaagccaaatcagcgaactggcgcttcgagcggtccaaatcggactgtctatgaagtttttggctactgcacttgctgaattctggaagcgtctctacacgaaaatgaatgataagagattgccagatcaagagagcacggaattaatctggcagattgatcgctttttcagcccgattaacacagaaatttttaatcaatactcaatctcatgggaaaaaacagtatccctgcaaaaaatcgcgctgcaagagctgtctgcgccgcttatcccggtgtttgaaaatatcactgtgatgcctcttgtcggaacaattgatactgaacgcgcgaaacgaattatggaaaatcttcttaatggcgttgtcaaacaccgttcccaagtcgtgctgattgacattacaggtgtccctgtcgtcgatacgatggttgcccatcatattattcaggcatcagaagcagtaaggcttgtcggagcaaaatgcctgctggccggaatccgcccggaaattgctcaaaccatcgtcaatttggggattgatttatcccaagttataactaagaataccctgcaaaaaggaattcaaacagcattggaaatgacggatcgaaaaatcgtttcattgggggaataacattttgagacatccgaaaatcccgatcttgaaactgtataattgcttattagtgtccattcagtgggaacttgatgaccaaacagcattaacctttcaagaagacttattaaataaaatatacgaaacaggtgctaacggagtcgtcattgacctgacatctgtggatatgattgattcatttatcgcgaaagtgctgggcgacgtcattacaatgtctaagttaatgggggctaaagtcgtcttgaccggcattcagcctgctgtggcagtgacgctgattgaacttggaatcgcacttgaggaaatcgaaactgcgctcgacttagagcaggggcttgagacattgaagcgggaattgggggaatagcgaatgaacgaccaatcctgtgtaagaatcatgacagaatgggatattgtggccgccagacagttgggacgaaacgttgcgaaagaactgggtttcggcacggtagaccaggctagaattacaacggctatttcagaattagccaggaatatttatttatatgccggcaaagggcagattggaattgaacaggtcgcagacagaggaaaaaaaggcctgaaaattatagcggaagaccaagggccgggaattcctgatatccgaaaagtcatggaagacgggttttcaacgtctggaggacttggtgcgggacttcccggggtcaaaaggctgatggatgaattcagcttaaattccgtagcggggaaggaacagagatacaagccatcaaatggcttcggtaggaggtaagaacgtggattttagggaggttattgagcagcggtatcatcagctgcttagtcgatatatagccgaattaacagaaacatctttatatcaagcccaaaaattcagccgaaaaacaatcgagcaccaaattcctccggaagaaatcatcagcattcacagaaaagtgctgaaggagctgtatccaagtctcccggaagatgtgtttcattcgctggattttttaatagaagtcatgattggctatggaatggcttatcaggagcatcaaacccttagagggatacagcaggaaatcaaatcagaaattgaaatcgcggcaaatgtccagcagacgctgctcggaactaaagttcctcaggaggaagcgctggatatcggcgccatcagtgttcccgctaaacagatgagcggtgattactaccactttgtcaaagacaaggaatccatcaatatcgcaatcgcggacgtgatcggaaaaggcattccagcggctttatgcatgtccatgattaaatacgcgatggactctttgccggaaacgggcatacacccttctcaagtgctgaaaaatttgaatcgtgttgttgaacaaaacgttgatgccagtatgtttattacgatgttttatgcgaattacaatatggacaagcatcaatttacatatgcttcagcgggacatgaaccgggattctattattctcaaaaagacaacacgttttacgatttagaggccaaaggactcgttctcggcatctcgcaggactatgactacaaacaattcgatcagcatctggaaaagggcgatatgattgttttattttctgatggcgtcacagaatgcagaacggaaaacggtttcttggagcgtcctgatctgcagaagctcattgaggaacatatgtgttcctccgcgcaggaaatggtcaaaaacatttatgacagcctcctcaaattgcaggattttcagcttcacgatgattttacgttaattgttttgcggagaaaggtttaacgtctgccagacgagggtataaagcaactagtgattagtgatttgaaggaaaatttgaggtgatacgaatgaatataaatgttgatgtgaagcaaaacgagaatgatatacaagtaaacattgcaggagaaattgatgtctactcagccccggtgctcagagagaagctcgttcctctggcagaacaaggagctgacttaagaatttgcctgaaagatgtcagctacatggacagtaccggattgggcgtttttgtagggacctttaaaatggtgaaaaaacaaggcggttcgctgaaacttgaaaatctttctgaccggctgatccgactgtttgacattacaggcttgaaggacatcattgatatttctgcaaagtcagaaggtggagtgcaatgaagaataatgttgattacatcgaaatgaaagtgccggcccaacctgaatatgttggaattataagactgacgctatcaggggtcgcaagcagaatgggctatacgtacgatgaaattgaagatttgaaaatcgcagtcagtgaagcgtgcacaaatgcggttcagcacgcttacaaagaagataaaactggggaagtgtcaatacgattcggtgtgtttgaagaccgtttagagattattgtggcggatgaaggagacagctttgactttgatcaaaagcagcaggatctagggccgtacacaccttcgcacacagttgatcaattatcagaaggagggctcggtctatatttaatggaaacgctcatggatgaagtcagagtgcaaaaccactccggcgtcaccgtagcgatgacaaagtatttaaatggggagcgagttgatcatgacacaaccatcaaaaactacgaaactaactaaagatgaagtcgatcggctcataagcgattaccaaacaaagcaagatgaacaggcgcaggaaacgcttgtgcgggtgtatacaaatctggttgacatgcttgcgaaaaaatactcaaaaggcaaaagcttccacgaggatctccgccaggtcggcatgatcgggcttctaggcgcgattaagcgatacgatcctgttgtcggcaaatcgtttgaagcttttgcaattccgacaatcatcggtgaaattaaacgtttcctcagagataaaacatggagcgttcatgtgccgagacgaattaaagaactgggtccaagaatcaaaatggcggttgatcagctgaccactgaaacacaaagatcgccgaaagtcgaagagattgccgaattcctcgatgtttctgaagaagaggttcttgaaacgatggaaatgggcaaaagctatcaagctttatccgttgaccacagcattgaagcggattcggacggaagcaccgtcacgattcttgatatcgtcggatcacaggaggacggatatgagcgggtcaaccagcaattgatgctgcaaagcgtgcttcatgtcctttcagatcgtgaaaaacaaatcatagaccttacgtatattcaaaacaaaagccaaaaagaaactggggacattctcggtatatctcaaatgcacgtctcgcgcttgcaacgcaaagctgtgaagaagctcagagaggccttgattgaagatccctcgatggagttaatgtaatgatccaggttgaagaaaacgagcatattcaaactctagtatatcaactgaataaagaagggaaatcaatttgcggtgacagcttttttatgaaagctgatgataaggagttaatttgcgcggttgctgacggactgggaagtggatcacttgctaacgaatcctctgcagccatcaaagacttagtggaaaactatgcgaatgaagacgtagaaagcattatcgaacgctgtaatcaggcgatgaaaaacaaaagaggcgctacagcatctatcctgaaaatcaattttgagcaaaggcagtttacgtactgctctgtcggaaatgtacggtttattctgcattccccgtctggtgaaagcttttatcctctgccgatttcgggctatttatcaggcaagccgcaaaaatacaaaacgcacaccgccacctatgaaaagggttcaaagttcattatacatacagatggactcaacgtacctgatatccgctcccatttgaaaaaaggccaatcggtagaagaaatatcgaattcgctgaaaatgtatacgacatcgagaaaagatgacctgacctatattcttggacagctgtcctaagagaataagaacaagaagaagctggaataccggcttcttttttttatgtgtttttttcggtttttgatacactagagaaagaacgacaaaattggaggctttggttacatggaaacgtcagcccttttaaaacagcaaattgcgaaagaaataggtttatcacaaaaacacgttgaaagtgtcatccgcctgcttgaggacggcaatacagtcccgtttattgcccggtatcgaaaagagcagacgggttcaatggatgaggttcagattcagacgatttctgaacgctggcaatacatacaaaacctgaatcagcgaaaagaagaagtcatcaggctgattgcagagcaggataaactgacagatgatctaaaacgtaaaatcgagcaatcggtgaagcttcaggaagtggaagacctttaccgcccttataagcaaaagcgtaaaacaaaggcgacagtcgccaaaagcaaaggccttgagccgcttgccgactatatcctgacacttccccaagatgatcgtctggcagcaactgcagaccaatacatcagcgaagaaaaagaagtgttcacacgagaagaagcgattgaaggcgccaagcacattattgcggaacaaatctcagacgagccgaccttcagaaagtggattcgccaggaaaccttcaaaagaggaaccattaagtctgcagccggaaagtcggcagacaccgatgagaaaaatgtgtatgaaatgtattacgagtatgaagagccaattgcaaaagttgttccgcatagggtgctggcaatgaaccgcggcgaaaaagaagacattttaaaggtagcgattgaaccgcctgcggatcacattaaggcgtatttagaaaaacaaatcatcaaaaatcgctcaacatccgtaagagagattttgcaggagacaattgaagacagctataaaaggctgatccagccggcaatcgagcgtgaaatcaggaaagagctctcagaaaaagctgatgaacaggcgattcatattttctcagagaacttgagaaagcttcttttgcagccgccaatgaaaggcaaaaccgttctcggtgttgacccagcctttcgaactggctgtaagctcgctgtgtcagatgagaccggaaaagtcttgaaaattgatgtgatctatccgcatgcgccagtcaacaaaacaaaagaagcccatgaaaaagtgaaaaagattcttgagcagtatcaagtcgagatggtggcgatcggaaacggcacagcatccagagaaacagagcaattcatcgtcaatgtactcaaagacatgccgcgcaaaatttattatgtgatcgtcaatgaagcgggagcaagcgtctattcggcttcagagcttgccagagaagaattccctgaccttaaggttgaagagcgcagtgccgtgtctattgcgcgaagacttcaagacccgctcgcggagctcgttaagatcgatccgaagtctgttggtgtcggacagtatcagcatgacgtcagccaaaaacgcttaaatgaatctctgcggtttgtcgtcgaaactgtcgtaaaccaggtgggagtaaacgtcaacacagcctccgccgcgctgcttcaatatgtagctggattatcgaagtctgtagcaggcaacgttgtcaaaaaacgtgaggaaatcggaaagttttcaaatcgaaaggaactgaaggacatcccaaggctcggtgcgaaaacctatgagcaatgtatcggtttcttaagagtgcaggaagggacagagcctttggatagaacaggcatccacccggaaagctataaagaaacaaaagcgcttttgaaaaaactcggactttcaacagaacatatcggcacggcggaattgaaggacaaaatcaatcagctggcgctttctgaaacggcaaaagagctgggaatcggcgaaatcactctgaaagacatttgtgaacagctgacaaggccggaacgcgatccgcgcgatgaggtgcctaagcctttgctgaaaacagacgtccttcagctggaagatttgaaagagggaatggaactgcagggcaccgtgcgcaatgtagtggacttcggagcgtttgttgatatcggagtcaaacaagacgggcttgtgcatatctcaaaactgagcaatcaattcgtcaagcatcctcttgatgtcgtatctgtgggcgatatcgtgacagtttgggttgacggcgtagatgtacaaaaaggcagagtatcgctgtctatggtaaaataaaagcactgcttacgagcagtgttttttcctatagaaataccagcattgattcagcagtttaatttggtaattatctttttcaaggaacgctttttgcatctgctttttaagccaatttggcataggctcattcctcctcagcttttatcataagagggacggtgattaccatattgtatgcgaacggtgaattgtcccgttcaatgttttttaagtgaggtgcaccatggataatatagagcttcaaaagctgacagaggatatttctaaaacatattttaaaaagccgttccgccatcaggcgctttttaatgacaggcttaaaaccacgggcggaaggtacctgttaacctctcataacattgaattgaacagaaaatatctgattgaacacggcagggaggagctgatcggcatcatcaagcacgagctctgccattatcatctccaccttgaaggaaaagggtacaagcacagagacagagattttagaatgctattgcagcaggtcaacgcgccgaggttctgtacaccccttaagaaaaaagaggaaaacaaaaaaacttatatgtatatctgtacggcctgcggccaacagtatataaagaagcgcgccatgaaccctgacagatacagatgcggaaaatgccgcggaaaaataaaaagaattttttcgtgaaaaaggttgacgaatatggcaagcctatgttacattataaaagtcgtcacgagagataaataaaaacatttacctcttgacactgcaaattaaggctgatataataagtcttgtctcattattccacagtagctcagtggtagagctatcggctgttaaccgatcggtcgcaggttcgaatcctgcctgtggagccatattggagaagtactcaagtggctgaagaggcgcccctgctaagggtgtaggtcgcgtaagcggcgcgagggttcaaatccctccttctccgccataagatttcgatataagttctcaaccatcggcccgttggtcaagcggttaagacaccgccctttcacggcggtaacacgggttcgaatcccgtacgggtcattccatttcgttgggctatagccaagcggtaaggcaacggactttgactccgtcatgcgttggttcgaatccagctagcccagccatttttatttttgaaatctaatagtaagagccattagctcagttggtagagcatctgacttttaatcagagggtcgaaggttcgagtccttcatggctcaccatttgtctttttgcgggtgtggcggaattggcagacgcgctagacttaggatctagtgtcttacgacgtgggggttcgagtcccttcacccgcactttatttacaaagtgcacgcaaatcggttttactaggttaagagcctactaaaccagcacaaacacaatttaatgatcacgcggtcgtggcggaatggcagacgcgctaggttgagggcctagtgggtgaataacccgtggaggttcaagtcctctcggccgcatcaatgataccaagggttgtagacctttggtatttttttatgctctcttataattttaaggtttactcctttttacccacttgttagaataatgcatccagcttatcagcagtttctttttgtttattggaaaagagatgcaagaaaaatcagttgttgttctgatgggagcatgtccaagtcgttcttttattgtgatataatcttctctttgatcaattaacaatttgacatgggaatactttagctgtgaagtcaggttggttaaactccttctcaatttaagaaccgctactataaaatcatgtgaatagcaaagagggacttgtttattaaagagagaatgtgaagggaacgaataggaaaacatctattcatttgataggtaattatgaaaaaagagattatcttaattactgagtactaggaaaatacatgatgcaaatatatgtcaatgagctatatagaatggttccaagttacgatgcgattgtcgtccatataaggtcactaaaattagagaaagtctatacaaactctaaaaagattcaaaggtgattgtgtaaagtttaaaatctttttgtggggagatcttttgcgttttccacccgtacttgtttatttagctttctatccccctaaactagatattcttagtccaatattgataaaaagaatgggcgatcttcctctataacttccttaaacggacaccattctcgtaactctaccttctatcagtcgcgttcccaataacctggttagatgagcaggttattttatttcaactgatgaattaatgaagctgtactttgctctctttttttcttttgaatagattgcacagagtaaaacctataccattaacccctgcatatggtagcaattcacttttctgctccatattcatacaccttggttaactacggctactttggtacgcctccaaacctctgatctaatttgtacgatataacctaaataaaaagggctataaagaagctgcccttaaaaattttaaggacagcaagatgatataaacttcactataaattaacaaataaacaaacttatgttacttctgcctaaacagccaatactcacattggattgaattttattactcttaggtatatcggtgtcataaagtttctgaagtgaaagaacttttttcataatgctatacctccagtttattcattagattgtgaaatagtaaaaacctaatggaaatcttcattaaaaaccacctatggaagtacaagcgtatagacttactgagctgccttgaccaccctcacaaataaaaatactgagaactgactttttatcagggctgtcactttttttcgttgataatttttgaagtgacaaaattttatcagacattataacacctcctttttgattatgattttgtaaaaaaagtgaaaattttcacttttctccattgtaatatttcccatagggtattacaatataaataacttaaattgcctaaaaaagaaaaaaaagaaatagaaaggtaatgagtcatggataatatatgtaaacttagttttcaattaggaaaatcaaaagtgaattcattaggtagcgcatctattatcatatacaaagatgaattctttgttgctactgcagctcattgcctatacgatgtaggcagtaatgaaatagctaaaaacatatcaatagaagtagagaactgtggaatgaaagaatcatatgatgtactaaatatagtaatacctgaaaaatggattagtactcataggttaacttatgactatgcttttggatggattaaattgcctgaaagcatgaggaatgttgcttttattcctaactttgatttaagtgggatgatagaagagcataataaagcggttacattagcaggctacccaatttcattttttaaatctcagaagaaatactctaaaggagatttagatttaactctttttaaagaagagcagcttattggaatgagatccaaacttaaacatgggatatctggcggtccttggttttttgaaagtgataatgaaaaattccagattggtgttacatctgcaagaattaaaagtttcaaaaataaggtttgggcgtctatttggactaaagatacagaaagaatactaaacaagttattgacaagtgagatgcaagaaaaaattattctagcctaaagtgagggattttgatggatttaagatatgttgagtttttgagcccaggcaatttattttatgaattggtaacaccgaataaaatagtaaacaattatcgtatcccaaacttaaattctgaagagtggaaacaaaacacggatattaattggagttattgtattaacacaaagaaaaagatgcccaaacaaggatggaaaatacatatcactacagatattgatgaggcacaaaagactttagatattgtccttccatatctcattgaaaatgaaatatcctttaaatttgttcctaatgaaaggcaattattattcaaaaactctaaaaacggagacagagcatcttcgggtaaattcattacaatctatccttacgataacaagacttttctaacattactttcagatttagataatctgactaaagctttaaaaaaaggtccttatatattgaatgataaacgctggaagtattcaaatgtcttctttcgttatggagcatttgtatctatgtatgtgaataaagatggacaaaatgttccagcaattcagcgacctgatggcacattaattccagatgtccgtgctccatattatgaagttcctgactttgttgaagaacctgttgaaatacaaatcatgactaaaaaagttgatgcagaacttgataaagaagacacatcgaagtttgattcatacaatgttatttctgcactgcattttagcaatggtggtggagtatataaagttgaaaaaaacgggaaaacgtttgttatgaaagaaggaagacttggttcaggtttggatcggttgaaactagatggttttaaacgaatttataaagaggctgaaacaataaagcaattaagtgagaagccttacatagttgatttttacgattactttgagatttgggaaaataactatttgattgaagaacatgtatcaggaatttctcttatggaatatgtatctcaaaactttccgttttcatataaagaagataaagatatttatatggaacgcatgatgcatgtgatagatcagttgattgatgctttaaaagatcttcatagaagtaagattgcactcggagatttacagccaaataatgtattggtattagaggattactcaatcaaattaatagacctagaaactgctgtaactcccgaaagcaaatacacccccgccttaatgactcctggttacgttacggatcaagcagaaacttttgagcaagcagattggtatgcattacttagaatttgcaggtttttatttttaccgatagaaaatttatctgatctgtcaattgatattgaaataaatcaagataaatggattggagagaattttggggatgcagttttaaataaaattcaagaaattcaagagaagacattaccaaccatcaagaaattaagtgaagctgctactttaacaattccaccaatgaaaataaactacaagaatgttaatgagataactgaaggtttgcgagctggaattatgagtcatttaaaacctaagtcagaaagtttaatatccggagatatcaggcaattcattgaaaaaatgggcagtctatcaatcgctaatggaggatttggtggaataatggccttggatagaacagggactctatccgattcagtttatcaatgggttgatcatgtattggagacaatattgaatttagacacggaaacatataaaaatttcccgctcggtttatttaatggtatctcaggcatattgtccgttttatacgatattggatataaagaagaagcaattaaactgttagagacaatgcctttgccagatactgaagattcagatttaacactgttttccggattatcgggaattggattaaactaccttgccttttatagcattactcagaaaaaaggctttctagatcgctctataaaaataggaaatagaataatagatgcctataaagaagactgctccatcactgtaagggatccttatgcaatgccgtatggcttgttaaatggctggtctggaatcagcttgtatattctaatgttaggcaaggcgacaaatgacaatgacttaataaagctggctagcgaaattttcaataaagaaataagcaaaaacattgaaattgattctaaattagaattagcacaaataaaagaatattcattgggctataaaaggttgataccatatcttggtgaaggtgcagctgggattgcattaattatgcttgaattcaataaaaatcttcctgattttatgacagaaagtaatactgaactattcaaaaaactaactaatgttacagacttatatagcacatttgcaagtggcatctttcgaggtgtgggaggaatgattattcttgcgaatgcaatgaaatgtgaaggggtaaatacaggctcattagaatataccattaaagcactcgggaattatctcctgtataagaaacacgaaggaattttaagtccaggagagtatggttaccgactatctttagacttacaaacaggaaacagcggattactacttgctctttctgatatagatagtgataaatggagtagttggttaccgttacctaaaaacaataatctgaatctctttgaaatagacaagttcattaaaggaggtgaaacaaatgaaaaagctattatctcttcagcacaaagcacttgataaagaggttactctattaaaaggcaagtcatcagtaagcttaggctgcgataagatcagtacagttagtttgtatttctgcggtaactaagattactcactgtttagactaaaggaggtgaaacaaatgaaaaagctattatctcttcagcacaaagcacttgataaagaggttactctattaaaaggtagatcatcagtaagcttaggctgcgataagatcagtacagtaagtttgtatttctgcggtaactaaagattactcactgtttagactaaaggaggtaaaacaaatgaaaaaattattatcacttcagcataaagcgcttgataaagaggttactctattaaaaggcaaatcatcagtaagcttaggctgcgataagatcagtacagtaagtttgtatttctgcggtaactaagattactcactgtttagactaaaggaggtgaaacaaatgaaaaagctattatctcttcagcacaaagcacttgataaagaggttactctattaaaaggtagatcatcagtaagcttaggctgcgataagatcagtacagtaagtttgtatttctgcggtaactaaagattactcactgtttagactaaaggaggtaaaacaaatgaaaaagttattatcacttcagcataaagcgcttgataaagaggttactctattaaaaggcaaatcatcagtaagcttaggctgcgataagatcagtacagttagtttgtatttctgtggtaactaatgattatggacaaccctacttaaagaaaagagaggggatcatcctctcttttctttgtattacccaaaaagtaaatacaataaactatttaaaaaatataaaaggagttggatgaaatgtcaagaggaaagcaaatcagtaatatcctgaaattgcagagcttagaaagtggtccagtatatactgcaggagcgacaggaactgttgaaggtcaatcacttatttcacctgctagtatagctttttgtttaactcctcttcctgtcagtaccatgagtgcagctttttgcaataactaatctcttgagagggttgtaaatatggacttacgatacttcaaatactttatctcgacaaacaattctttttatacaaagcccgatacccctaacagggaatcggctttgtatatttctaatatacctaataattataaaaccataagagaaaatcattggattcatgttataaacaaagagcataaacttccaatgcaaggttggaagatacatataagtactacaatagattctgcagaaaaaacattagaaattgtatcaaatgtcctattcgattacaaaatctcttttaaatacgttaaaagcttatgggaattaagtattaaaaattcaaaatacagcaataggtctgctgcgggtaagtttattacaattttcccgccaaatgaacaagtatttttaaatttgttagaaatattaagcagtctgctagatactcttcctagaggcccttatattttaactgataaaagatggtacgaaagtaatgtatattttagatatggtgcatttttaagtatgtattattatgaaaataataaaaaggtatttgctattcaaagtccttctggtgacttagttgaagactcaagaagtcctcattattctatacccaaatttatcactgaacctgctccaataagagagatggataataaattagaaaacgaaatagctgaacctactccattagatgatatagaggttatccatgcaattcattatagtaatggagggggagtctacttagccctagataaactagacaaaaaagttatccttaaggaaggaaggccaaacattggattagatagtctgggaattgatgcctttacaagaataaaaaatgaagcgatgattttaaaaaaacttgaaggaacgcgttaccctgtaaaaatatatgatttttttaaggcgtgggaacataattttattttagaggaatatattgaaggcacatcactgagaacttggcttgcaacaaaatatcctttttatacgaatgaaacaaataaagaatacttaaaaacagtattaaaaattttgaatcaattaatagatgctctaactgaaatacataatcaaggaatagggataggagacttacagccctcaaatattattatcacatcagacgaaaatatacgattgatcgactttgagactgcaagttttattgatgatagtgtaccatcgggtttaaaaacatttggttttactggcgggcctaatatgacgagaaaacaagcggattggtttgcgttactaagaatatcgagatatttatttttacctatcggaccagttcaagatatttcttcaaaaattttagaggcacatgataaatatattgaaaattattttggcatcgaagctataaaaataattaataaaatacaaaaaatttgttctcaagttcaggcaaatccagctaaagatttattgaatgttgaacataaccatattaaagaaatgtcactaaatgaagtaaagatgttacttcaaaataatataataaataatttgtttgttgatgaaagggtaatcccaggagatattagacagtatgaattagaaaatggattatttaatatcttaactggcggttttggagctgtattagcctttaatagaacaaatatacaaaataaaaaactaaacgaatgggtaggtaatcaatctttaaacgatttattgaagatggaaaatggactattaactggcaaggctggaatagccactagtttatgggaatcaggttattatgacaaagcaaaacatctttttgatagcattaatcattttaaaaataacagtgatataacgttatcatccggactatctggaatcggtttagcttttttaggcctttcatatgaaaaagactctatcaaatatcttaacaaatctatagaaattgcaaaccggctagaggaattattagaaaaagacgtttcaatcgttccttatgatatggatataatacctcgtggtcttattaatggttggtcaggtgtttcacttttttattcttctttatataaaagaactaaaaatcataaatggcttattttatcgaaaaaagctattgaaaaagatttgatcactggtaaattcgatgattacggcgtttatcaattagaagatatcactagagtagtcccttatttagatggtggaagcgctggagtgggattggcattaattgaattaagtttacttttaaaggaggatttatgggagaaagaattggaaggtatttacaaaatagcgaaatcgaagtgtttttataattgtggattatttagaggtactgccgggataatggctgttagtaatgcaattgataaatattataaccggggtataaatgctgataatttgaaaactttagatctacacctctttaaaggaaaggtcgaaatatatactcctggagactttgggtatcgtttatcaaatgatatattttccggttcattaggattgttgctcgtaatacaaggtattataaacaatactaattatatgtggctccctgtgatgaacatcaaaaaagtatttgagtctaactcttaattatttatctccctcaattaagagtgtaggtagaaacttttctaatatttttttgaatatggatatccgaagtaaaaaaggagattattatgagacctaaaaaccccttattctttttattatgtaaaataaaacttccattattattaattttgtttgctatttctatttcatctataggcagcattagtggtttgtttatacctctatttacaggtaaggttgttgataaattttctgagaacacctttgattggagatttatagtaatttttttatgcatgtttttaattaacgcgatcttgagtggtattgggttatatttgctcagtaaaattggtgaaaaaatgattatggcaattcgttttatgctctgggaacatataatcaaattaaaaacctctttctttgataataatgagagtggttcaataatgagtcgtatcacagacgacaccaatgttatcaacacttttgtatctcaaaaattacccaatataataccttctataatcactattttaggctctgttatcattttattaagaatggattggcaaatgactcttataactcttattatagtgcctatatttttagcaataattatccctttaggcggaatggtaaggaaaatctcaaaaaaagcacaatccgaagtcgcaagctttagtggtttattagggcgtgtcttaacagaaatacgtcttgtaaagatatctaatacagaaaatcaagaattgaaaaatgcttataacaacctttttgaaatatataaattagggttaaaagagtctaagatcatttcaattatacaacctttaactagcctcatccttttactgactataggaattattctgggatttggcggtataagagtctcaacgggtgtaatatctgctggcaccctagtagctatgattttctatgtcatacaattatcaggccctttgactaatttttcaacgttacttacagactatcagcgtgcgataggagctagccaaagattaagtgaaattctacttgagcacaaagaagagctagagtccaataagaatgctttagatattgatttcagcaatcaaaatttgaaattttcagaagtaagtttcaaatatgatgataaaccgattttgaatgaaataacttttgatatcccaagtagaaaggttactgcttttgtaggaccgtctggttctggtaaaagtactattttcaatttaattgcacgtttgtatgaattacccccaagtaatgggagcatatcactcgaaggaataccgattaacgaatttaacttatcagattggcggaataaaattggatatgtaatgcaaaccaacgcaatgataaatggcaccgtaaaagataatattacttatggaatcaaaagagaaattagtgaagatgaaattattaagtattctaaattgtctaattgccatgaatttgttatgttgttagataaaggttatagcacaataattggcgaaaaaggagtgaagttgtcaggaggtcagcgtcaacgaattgatattgcaagaaactttattaaagatcctgatattctattattggatgaggcaacagcaagtttggacagtgagagtgagagaaaaatacagaattcactagaagaattaatgaaaaatagaactacagtaataatagctcacagattagcaacaattaaaaaagcagatcaaatcattttcttagaccaaggagtgattactggtaaaggaactcatgaccaattaatgcttacccatgaaaagtacaggcgatttgtgtcagcccaaaaattggctaactaactaaattacgagctcgcccctttaatctatttattagtaaatttaatatcatcatctaaatcatttatgttaaatgaattaagataccttacaaatttagtgtaatcttaacaatgtaagatgaggaatactttttgcattagttaaactgaaaagcagctaattattcggcatagtctgtggatgttatgttttgataagtagtaataaatattactttagctgtaatttgactgcatatactttgattgagaacataaaatggttatagaaaaagacggataacccggttttaaagtaattataaaaaggagttataacgatggtaaaaagattttttctggttttactcacactaattatgtctatagttgttatgctagtggctgctaaaaattctcctggagataatgtcatttcatttgaacagcctcgaatattaatgatatcaattgggatagtggtatttttattcattccccgttagtcatgtccttttttggtaactgggttgtaagaatcgtatctggtgtataccaatgttttatcgttctaacctttctggggctcattccaataggatttcttattcccgatggctttttgaccattgttgtttctattgcaggaactttaatcagcatagttagcgttgtagtaacctttattgataggaataaagaagttaaatcttagctgaaataataaaataaggttagaaggctttatccttaatttcaaggaaaggagctttctttttttataggtttatatgttgcgaatgactaacgcccttgatgacttatggttgcttttagtgtagatactcggaaagagagttacagggcgtatcttaacagttcctaaatctacagctcccaaattgttcatttacaataaaataaatcctctcaacgggctgcaatttcttgtccataatttctcggtgtccttgagattccaaaaatagacgcagagcttcggactgtagaaggaacggatgcggatgatttggaaaaaggagtcggccactacaaaggcagttattatccagatgaaaacggacaaattgttctatcgggtcatcgggatacttaccgtattccgccggacaggggaactaaaaaaaggtgatcaattaaaggttctgctgccatatgggagcttttcatatgaaatagacaaaacaaaaattgtagacaaaaagatacgtctattattaccctgcagcataacaaagaggagctcattctgacaacttgttacccgttttcatatatcggtaatgcaccaaagcggtatattatttatggaaaacagatttgagaaattcagaatatcaaagattaggctgacgaattttcgtcagcctttttcgtcaggttctttctgcattctggtccataattaaatcaaaataatcttagtaaacataaaagtattttatgtttttgtataagtttactttacttttatataaggtcgatttataatttggttcaagaggtgatggtcatgaagaaagattttggtgattcgatctcaaataaggtttatgaatatcgtgtacttgccagattgtctcagcaagaattagcaaagaaagtcggggtttccaaacaaaccatctttgtaatggagaaaggaaattatgttccgactctgctgttagcttttcgaattgccgaattttttaatgtggatgtaaacgagatttttacttatgagaaaggaaatgatcaaaaatgaaaatgaattcgatcacagatacgatcactaacgcaattttttctcctttaaagtcctgggctgaacattctccgggaaattggaatattcttattggcagtgggtttgtattgcttgtagtcggattgattctgacattcgtatttactaaaaaaatgggtaagactgacgaaagaacaaaccaaatcgctttaaaaggtagcctctgtacgttatgtgcactaattttttgcgacttgcttttcccaaaagaatatatgtggcaagttttcttcttatttaagtattctattgcattcttcgcttcagcaatctatctagccgttcgatataaaaaagattttttgtaaattcaattaccgagaaagatagtgtctctgctcaccaattattaaccacaattcatataaaccgttagaaatgaagtaaaatgaagttagaaaatgtaatgaaaacaagctttcataatcaatgatatggatttacaatgttgagggcccagtggggtgaataagccgtaaaggttcaagttctctcggccgcaccccaataataccaagggtttaaccatctttggtgttattttttgcggaaaatacggctgtaccgcattgtggagtccactaaaaaagtgctgacctctgcacaacatcgttgcgcgagtctgcacttttattctgcgattatggggagtttatttaatccgttgttagccgcgccgatacttggcttttagaagctttttttaagtggctaaaaccaacaaattttttgccttcttcatcccataggcggaactttaacgacttaaggctagttgccagtgtaatggtcggaacgttttgcaatggttcagtgttgttatgcactttttcaagcttatagtttgggactctcgggcttaaatgatgaacatgatgaaaaccgatattgcctgttagccactgcatgacttttggaagcttataaaaagagcttccttcaactgctgcttttacatattcccaatgctcatcttcttcaaaataagaatcctcaaacgtatgctgaatataaaacatccaaattccgagagagcccgatatcataaaaatcggcacctgaaccagcaggaagttttgccagccaatagcccaacataaaagtgctgccaaagcgacgatccccaggttcgttacatacgtattcatccgttctttgcgttttgccccttttcgattaaaacgattggcaatcccgaagacgtaaatcggcccaataataaacataacaaacggatttctgtacaaacggtacattatttttgtcttagttgaggcttctttatattcctctaccgtcagtacccaaatatcgcctgtaccgcgtttgtccagattgctgcttgtcgcatgatggacagaatggtcgtgtgcccaatgatcaaacggatgcagagtcagaattcctgttaatgttccaaggattcgattcgcctttctgttcttaaaaaaggaatagtggcagcaatcatgaaagatgatgaaggttctcactaaaaaacctgccgcaacaacagaaatcgctaacgtaaggaaataagaaatcgacaagctcttatatgccaaacaccataataggaaaaatggtaccaatgtgttaatgatttgacaaatgcttttgtgtaaatcggacttttcataaggtgtaaccagttttctcaaagtccttaggttttgttctttcatattcaaaagtttccccttccctggtgatcttctaagtgtagaaaacgttttatagcctttggaggcccaacgttatacaccccatatatgataagtattcttcccattcatctgtaaaattattgtaaataataaactgatttccagtttattattagcagagtcagccgggatacaaaaggcgtatgaagattatacccagcactttatcgggtcaaactctctcaatgctccgccatggggatcgatttatttagatcgtgaacattgattgtttgaggaaaaaacggaatgaagtatggggatatccatgagtgactgtttggaaacatctgcagaaacaaagttttataagtgaacagccctgcttttaaaagattatcttgctcttgataacaagaaacagctgagctttttgacaaccattaatgaagtattattaagcaaagaaaaaggtttgaagccactcgtgattcacttttcacggtgttttcaaaccaaagtttttaataggtctcttattctgcgctggtatacacatgtttaacaaataatgccatgaataaatcagaaatataatttgcagttatttccgattcctgatataataaagaagaattatttttgttcggtgtaaaggatagtatgaagattgacttttcgtcttgatgatactttgggcaaggatagtatatactgtgtggttacacactaggaggcaacaaaaatggaacaaggtacagttaaatggtttaatgcagaaaaaggttttggctttatcgaacgcgaaaatggagacgatgtattcgtacacttttctgcaatccaaagtgacggattcaaatctttagacgaaggtcaaaaagtatcgtttgacgttgagcaaggtgctcgtggagctcaagctgctaacgttcaaaaagcttaatcttcaatcgtttatacaaacaggctctttatatagggcctgtttttttatgtctatatcatactcaataaaaaaccctactcaacgttcgagtagggagatgctacaaggtatagaaaaagatttaaaacttcaaaggtttgtttacagtataacatactggattgacaatatgcggaatgtatataaattatttaatgttttgttcaaatataactctttcttttttcacgttcgttactttaagtaagattagatgaattataaaaatggtttcatctggatgtaatcaactcgcatatctcttttatgagaagaagataaataattattattcaatgtggcagtggatataagaaattcttaaaaataatgaggagatcgattgtttttttctcctggaaataatcacttagagatacctaaaacaatgaaagccctacctctcttccatccttacggctccttgtccgtgccagtgtgaatcagatactaaaaacaagtgactattttattgagttttttggtaaaacttcaatcttcgcagaagaaatgtaaataataaaaatggattagaatgtaggaataacaaaagaggtcgttaatgttctaaacataagttggagaagatttgcttttcatcataatattccgaaatattttttgggatcaatacactatctaaccgaaactttttatttgcttttcagtgattcctttaattacttccagttcactaatcaaaaattcatatgcattatccagcatttttttttcgcttgcattaagtgctttttctttcttcatacgcattaaatcacgtacaacttcagcgccttcttgtatttcacccgtttttattttgtccgtgtttattttatacctttgcttccatggcagtaacctatctgattctccatgctgaaaaatgtgcataatgtgttttaatgcaagtatatcggtaactggtcgtatattcgaactcaatattttacgcgttggaatcataacggtcatattactgattgacattcttatgacataatactgttgtttttcctctaagaattctttttcttctatggcttcaattatacctgctccgtgcattggataaacaatgttatcgccaatttgaaacatatcatccacctccatatatggtaaccttcttaagattaccatatatggaggtgggatatcaaacttttaataataacatgatcgaattttttatgtcaataactttttttaaaaaaacagatcaagcaaaaacaatagggaacgtgtcggatttccaatcaaggaaaaggtcaattgatccgtgtatatcctaaaacttcgactaattaacatagatcagtttttcattgaaaatgggttattcaatttcctttaggaattcatgacttggctcaatgacattacagaaatgatttgagtagataagaaagaacgatattcgtgaaatttcagctaaaaatatttaaagcacatgattaagttctaatttctttaccgatttgatatggataacggcccacttacttaatgatgcattttcacttatcttgcgaacagaaaaaggtttgttgataatgaacattttgccaccaaattggcattattatcagggaaattgacaaccttcaaatggtattgaggtgagaagaaaaataaagaaaggagggattataaatgaagaccagaacataaagaagtaaaggggaaagaacaaagttaattgaaaagcaaactatataaaatagtttgcttttttttgttatgaattcactctttttcttactctttaatgactaataaaacaccgctaagaattaaaaacgaacctatccaaaatgtcccgcctatttgttctcccagcagaatccatccgagtaaggttccaaccagaggctgaaaaaagaaaaagaggcctccacttgaagcatttaataattgtaagccgcggttccacaataaaaaagcacaagcggttgaaacaattcccaaatacaaaagaccacctagaattttagggtcatgcagttgtggcgtgaaaatcgtgctaggttttacaaaaggagttagtgccacaatggccacaaaagttgaatacgtggtaacaagtataggcgaatagctgtttggcacgcgtttgataagcactgacatcagtgcccatgtaagtgctgcaacaagcagagaaataccgccaagctgattagaggtatcaatatgtccgtttccaactataaataatacgcctgtggttgctaaaattattgaagttcctttttttatattcaatggttctttaagtaatagacgagcaaaaataaccatgaacgctggtgtggaggacgtaataattgctcccatttgtgctgaagacaacatcgttccatattcttgtgtaacaattgaaatggtgttgccaacaattccaatggccacaattaataaaagatcgcgcttatgaattttccaagattgtttccttattaaaccaacaataagaagcgcaaggatagcgatgacgtacctgatccaaaccaattcaaaaggcggaattactgcgacaacaaccttaaccacaacatacatgccaccccagatactagcggctaaagctaaatatatagaacctaacagggtatttttcattttttgttccctccgtatttaaaattaggtcaataaatgccctaacggagagaagtagtcactttactccattaagggcagagaagtgctactggaacatcattttcaaatagtggagctaaaaacatgttatgatcacctcgatttttaagaatgactatcattatacaatgttggttttaaagccgtaaacaccttaaggggactccatttaataatagaataaactttataaattcatttttttgtatgataatggcgtcatattcatcgcttgttgaaatttacttatgaaataactggtactgttaaatccaacttgataagacacttctgtcacattggattcagggtgttgcagtaataataagcttttttgaattctataatccattacataacgtaatggcgtcttattcagcattcgtttaaaataacggcaacactcagaacggctcagttggccagcttttgcaatgtcctctaatgtgattttttcagcataatggagatggatccagtttaacatttgtttcattcgatgactttttatcatttcagattgatcgtactctaattgaaaaccattaacgaccaggtttttccacattaacgttaattgcatcgtaatgtcaatctcatagagcgatgtcttttgttgaatcaattgatttatttttttaacagcatctagaatattttttgcccactgttgatttccatccaaaaataaataggacaaattggttgaaaacatataaggctgaacatagcttgaatacagttcttgagataaaacgaaatggggtgacacatttaagcaaatatacgtacaatccgagccatccttttcttctgccatgtgcaggcagccactattgataaataatccatccccttcgtgaacctctattttttcttcatttatttgaaagagagctatcccttttagtatcaaaacaaattggatttcatcatgccaatgaagcggaatatagccatttatattttgattgatcgttgtcttgtaacaggcaactggtaattctactgttcggtgctctgttaattcttttaaattttgatcgatcacaaaattcttcattctgacttctcacctcaatatatttatattttttcattcgatttaagtattttttatcatgttttgcatttattataacactattattatatttattagtgaggagtcatgtatgaatacttccaatagaagaatgggattgttctatgttataacaggggcgacatgttggggaattggaggcacagtagccaaaaaactttttcaagaatatcaaattgatgtcaattggcttgtaacgacacgcttgcttacggctggaatgttacttttaatgctgcaactgttcagaaaggatcggtctcaggttattgaggtttggaaaaacaaagcgtcggctggccagcttcttatttttggcctattgggaatgctagctgtgcagtacacatatatggcatccattcaacatgggaatgctgccgttgctactttattgcaatatttatccccagtaatcgtcattatctacacgcttttccgaaaacaaacggtccttaccaaacaagatatcattactgttgtacttgctttagtgggttgcttttttttgttaacaaatggttcaatatctcaactttcagtgccggcagctgcagtagtatggggagttttatcaggattcgcggcagctttttatactttatatgccgttggtttattacataaatttgattctcttgtcgttgtaggttgggctatgattattggcggttttgcattgggttttatccatccgccatggcaactggattttcaacgattaactgctgaggcgtatgcatatattttatttgtgatattatttggaacaatgattgcgttctggttcttcataaaaagcttggaaagcctttctcccaaagaaacaagcctattaggcagcttagaacctctatccgctgttgtaacaactgtcgtttggttaaaagcgccatttggttcttttcaatggattggtgctatttgtattatagggataactttaatattggctttacataaagagccttctatgcagagtgaaaaatctttattaaagattaggaatcatgcaaatcgggatatataggggctttttttgcttacatgaccggtccggcaatgaaaaacactggtggagtttgagccctctcggcagtatcaaaaataccaagggttttgacgcccttggtattttttcttcaagaaccttcaattcttcttctctgatcgaaaaacgtattacttttttgtaattggtatccaaatttcacttttaaaagatggtgatgttacatccttatgctcgttccacaatatttctggaccttctatttgttcgtaatttgacgatggaaaccattcggaataaatacgtccccatacttcttgcagtgtatccggaaatggtccgattgattcgaatacagcccacgttgaggcaggaacttcaagccgtgagaagttatctggacactgtttcgttgtggctgcgccaatatagtgatcgagctctcctttttcctctgtccgaccttcagaaaaattggtggatgcactaatgagtcctgatggtgctacattagaaagctcttttagtttatttattgctttttcatctaaactttcccacatagatgcaatctccggattaatccctttaaaaataataggaactctttttttaatgccagcgatgcgaaatgcctctttttcttcaatacggtagttcatttcatttcctcctttaattgttagctggaaggtcattcgtggataagctttaaggggatggccattaagtctggcttttgatgggtttatgccatgtaaattttggaatgcccgtgcaaaagaatcaggtgagttataaccgtactttattgcaatatcaatcacttttacattgctgtctttcagttcaaaagctgcaagagtaagacgtctgcgacgaatatattccgataatgaaatacctgcaaggaaggaaaacatccttttaaaatgatattcagagcagaaagcaagctttgctgcctcttgaaaatcaatatcgttagtgaggttttcttcaatatactttaacgccctattcatacttttaagcaaatccatttatttgacctcctttaaccaaagaataacaggagtgaaatgtatttatccgacattctgtgcacagttttgcaggatgacttatatgaaataaagtaagtgattcacttgtatttgtacaggttttattgaagcatgctgttcataaaaaggcatcaataaagaaagttataattgtcttataagcagcacattcatataattgagtgaaaaaggatgcgtatcatgcctatcaattcttttgaaaactatccgatgagctggaagccatcgattgataaagctgaaaagcctatttataaagcacttgcagggcaattggaacaggatattttaaacggagttttattacctggaacaaaacttcctccacagagagaattggccgattatttagatttaaatgtgagtacgatttcaaaagcatttaaagtgtgtgagttaaaggggttgttaagtgcgactgtagggagcggcacatttgtatcgtatgatgcgttatcgaattcgtatttacttgaggatacaaagccgaaacatttaattgaaatgggagcaatacttccagatcacacttcctatgagcccttgttacaccaactaaaaaacatggttcaggaggaggattatgaaaaatggtttagctatggccgggcaggtgaaagcctttggcaaaaagatgcagctgtaaagctcatccaaagaggcgggtttgaaacaactgttgaacacattttatttgcaaatgggggacaaaatgcgattgctgcgactttggcgagtctttgtaagcctggagaccgcatcggtgttgaccatcatacgtaccctggattaaaaactgttgcatcattgcttagtgtgcaaatcgtaccgataaaatcagaaaacgatgaaatgagtccggagtcacttgaatatgcgtgtaaaaacgaaaatattaaaggtgtgtatttgatcccggattatcataatccgacgacttcctttatgtctgttgagaatcgaagaatggttgcagacattgcaaagaaatataatctatttgttattgaagatgcatcgtaccatcttctcaacaaaaatccgcttccggcactcgcctcattcgcaccgcaacaggttatccatattgcaagtttatcaaaatcgttagcgccaggtctgcgtttggcttatgtagcagtgccgagacaatataaggagccaatatcaaaggcgctttataatttaaatataaccgtttccccgctattagctgaacttactgctcgcacaattgtatcaaatcaatttgaagtcttaattgagagtcatcgtgaacaaaccattcgcagaaatcaactcgtaaaccgatatgttgcgggatatacatgtttaggtgttgaaacaggcatttttcgttggttgttgttaccgggtaaaatgtctggtgccgaatttgaagaattggctgctcgacatggcgtgcaagtgtatgcggctgaacgctttgtagtgggaaatagttgtcctgaaagggctgtaagggtttctgtctgtgcaccaaaaacacttgaagagcttgaacaaggattaatgatcctgagacgtttgctagacgatcttacctaatattgtttgccatacaattaagacattgtatggcttttttgtgcgtgttatgatgatccacatctagagggaggtttatacaaaattggcttttagaaaggaaggtcagatgatgttagacaaggacagcgtaaaagcaatagatgttcaaactgcttcattacaaagctacatcagttcaccagaaaaacaaaaatcgttatacaagcgtacactattcgttgtgagtatctcacaaatttttggcggtgcggggctggcggcaggagtgactgtcggtgcgcttattgcacagcatatgcttggcactgatgcgtttgctggtctgccttctgctttatttactttagggtcagcaggatctgcattaattgttggaagactttctcaacgttatggccgtcgaacaggtctttcagctggctttatgattggcggacttggagcaataggcgttattatggcagcaatcataaatagtattttcttgttatttatttcgttgcttatttacggtgcaggtacagccactaatttacaggcccgttatgctggtacagacttagcaaatcataagcagcgggcgactgctgttagtattacgatggtttttactacatttggcgcagtggcaggtccaagcttagtgaatgtgatgggggatttcgctctttctattggtgttccatcacttgctggccctttcattttagccgcagcagcatatatgttagcaggtgtggtccttttcattatgcttcgtccagatccattagttatagcaagaacaatagaagcggcaaatgaagagcctggtgataaaggacatttggcggcagctgagcatacagaaaacaaaaaagggataatcgttggggcaacggttatggttcttacccaaatagtaatggtagctattatgacaatgacaccggttcatatgagacatcatgggcatgacttgggggcagtagggcttgttattggttttcatataggtgctatgtatctcccttcactggttacaggtgttcttgtagataggttgggacgtaccgcaatggctatttcctctggaacaacgttgcttttggcaggtgtaatagcagcatttgctccgggagattctatggttcttctcgtcattgctctttctttactgggattagggtggaattttggtttgataagcgggactgcccttattgtagattcaactgatactgccacacgagctaaaacgcaggggacagtggatgttctgattgcgttgtcaggagctgctggcggggcactatctggaatgattgtggcaggttcaagttacctcgcattatcacttattggagggattttgtccttattactcattccggtggtggtatggtctagggaccgctaaaggataggattgtttaatttacattaatttgttatattgttagataaagtctattgcgtcgtctaataatctaactaactatagttgctccattaaatctaaatcagcaattttggtataaagatttgtgaccaggattccttatagctgtgtcactcactgcatattctttaatagaatcacataaaatggttatcggatttgaaaaaggcaggattactcgctttaggtaaaggagtcatcacgttgttaaaaaggttttctcttgtttttgttacactaatgatgtctatacttgttgttttagcggccgctaaagagtcgcctggagatcatgtcatctcatttgatgaacctcttatcttgatgatctcaattgggatcgttgtatttttatttatccctccattagtcatgtccttttttggcaatttggttgtaagaataatatctggtgtataccaatgttttatcgttttcacttttctggggctcattccaattggatttcttattcccaatggctttttgacaattctagtttctattgcaggaactttagtcagtatagctagtgttgccgtaaccttatgcattggcaagaataaaaaagatatataataattgaattgttattttttcagattgtcagtggaataataaaacaagatgagaaggctttgtgggccttctttttttatgttgtggacatggatatagcccatgatattttttgttgttgcatcatcctcactttaagcttaatctattgaataataagagaaggaacctatagaagaataaaataaataccgagatgtcaaaaataaaactggacttcattattatcaattcacgtaaatgtaaaaagcttggaaagaggggaattccttcatgacaaatagcagaacgaatccgaaggttgatgaatttttaagtaaagcgaaaaagtggaaggaagaatttgagaagttgagaaccatcattcttgactgtgagctgactgaagattttaagtggatgcatccttgttacacatacaataataaaaatgtcgttttaatacatgggtttaaagaatattgtgcgcttctgtttcacaaaggtgccctattacaggatgcccatggaattctcattcaacaaacggagaatgtacaggcggcgcgccagattcggtttacaaatgttcaggaaataaatgagctagaaaacattttgaaagcctatattcacgaagccattgaagttgaaaaagccggtttgaaagtggaagttaacaaaaatattgaattgaacattcctgaagaacttcaaaaaaaattcgatgaaatccctgcattgaaaactgcttttgaagcattgaccccgggacggcaaagagcatacactctttatttttctcaagccaaacaatccaaaacccgagaatcgagagtcgaaaaatatgtgcaaaaaattctcgatggaaagggattaaaggattagcccgccaaggttcaggctaaaggaatagcatcatagcgtaataagatactttctatagaagaaaaaacaagcatagtaagatgcttgttttttcttaggacaacattcacttactgctgaaatgcttcttttgattaacattgtatgccactagacagcgttataaaatattaatgcaacacctagaaatagctcaatggtacggctcatcacatttagaatgcctaggagaactaatagaaccggaagatttttagcaagttactgcactccaaactttgttttttgtattaatataccttattaaccattgtttttagtcaggtgcagacaaacgaatactaattaatgaatcatcatgatatcaatgagccgcttgattttttcattgtcacctgtatcaacatacactgtttttctgttttttatgatattctcagtcacttccctcatgacgcctttttctaaatcatcagcggaatcccagcgtaaaggcacattatatacatgaatcgtgccatccccattgccatgataagtgactgatccatccactaaacgagaacctgctaactgggtcacatcttctggatagctggcacttgtatcatcattaggattaattggctcgccagccgaaatatgtcgaacatttaattcatctatctcttgattaggtccaagttgaagccaaactctggcatattcgattttttccgaagagtatgctgccaatacattgtcttctttgcttttctcttctgctgaagaggtattatttgcagcttttgttgcggattcttctgattctgttattggctccgcttcatccttgtgtattttggtgctctcttcaggctcagtgtgtttttcgtcagattgtacagcagaagcttgatttgaaggttgatgtgcttcttcatccttactgcccgtacatccagcaagcaaaatcatgagcagcagggcagtaatacaaaaatatatctttctgtgtttcttcattctttcattcattcctccctctccattaactcaggtcagcttcatatataagtttatgtatctaaatattaccatggaatagataggatgatattgaaaactgtttaagaagaggaaacgatcttgaataacatcgcgaaaacttaagaattcttaagaagttttgcccctttttctgtgttttcaagcgggaacatgatgaaggatttagaacgtaaatatccagagttgaaaaaattattggagacttacaattataagtttttggcgctggggatgatttgtccaatagctccaacagatgtcgtttgttttttatcggcagctgtaggaatcaagtataccacttacattttaacggttatcgttacgaatatccctttattgatattttcgagtttcattgtgatcaattttagtgagtgattaatgggaactgtattggttgtcgcatcatttgttttggtttctattgtatccattaaaatgtggaacacccttaagcataaacggagcacatagaaatgccacgggactaaccatttatagcttataagcacctgtagagatttaagttctttcggtatccaataataccaagggtataactgcccttggtattatgttctgctgcacatatataaaccctccattttcgtttgtagatcctttttaatttttgtattttaggttgaatgatcaccagaagaaaaatgaacgcatgatctgaaaagctgttttgccgcaaaataaattaacgataacaatcccgctactacgatatattgtgtgtctgattttgattactgtatataagcgttttttagtaaatgctctttcattttttgaattgccttcgcttcgtcggctccatgagcgtatatatgtatttcggttcctggtttaattcctaaatccataatgtccatgatggcttttggcgcttgtttgaggttaacagttttcccttggtattcaagaaaaatatctgatgtaaaccgatgagctatactgactaacagggtagctggtcgcgcaaaccctgtttccttaatgatcgtaaattgtcttttaatcattcttcacctcattacattctgcctcttgacggatttatagttgggctgcagatcaaatttgaatttagagtacctttaggataagtgatctaatttcatcattttctctgcattttgaaataacaccctttctttgtgtttacaaaataattctcaactaactaaaatggacaatgacttcattcgagaaaaaagcatgattcactaatcaacatttgtttattattgtaaataaaaacttggtgtgtacaatggttacattcaggcgatttgttgattattcaacattccactctaaattgttgattatcttaagaaagtttggtgaaaagctatgtccaaagtggatagaagaataaccaaaagccaagaggctattaaaatagctctgattgagctgatgactgaaaaaagttttgatcatattacgattaaggaaatttctgaaagggcaaatgtaaaccggggaacaatctatcttcattacttagataaatttgatctattagaaaaaattatggaagagcatataaacaatatgggggatttttgtgagtcggcagctgaaatggactggattgaatcgactgtacactgcatggaataccttgagagtaattatttattcttttcgacgatgttagccagtgaaggcgctcgatattttcgcagtcagttccttaagtttaatatcgaagagttcaggaaagatgtagatgtaacgaaaggcaagaattacggccaaagtgaagatgtcattgttgaatttatagcaaatgcttacgtaggggtagtggaatggtggttaaaaaacgaaatgccttatccgcctcgtgtcatggcagaaaaagtgggggagttattagagcggattttataatggaggtaggaaatgggtgttgacttatttgtctaggcgggagattcaagtctcctcgatcgcatacaaaataccaagggttgctggcccttggtatttttatactttcatgcatttttgaagtttatgcttaatggtctgccttactttgcaaatcgccgagctgcggcaacgcacatgataacggcgatattcactgctacgagtgcccagcctactttctcgtgcagtatcactgaggcaagcagcagtccaaaaaaaggctggagaagctggagctgcccaaccgctgcaattcccccttgggcaagacctcgataccagaacacgaagccaatcagcatgctgaataaggatacatatgcaagactgagcagcgcgggaacgccgatcgccgaccatgagtccggcgtaaaaaagaacgacaatggcagcataagaggaagcgacagaacgagtgcccatgagatcacctgccaattccccagacgccgtgaaagtttggccccttctgcataaccaagaccgcatacgacaatagaagccagcatgtacgcgtcgccaagcggggatgaacctcccccctgaatgagggcgaaacctgctactaacaagctgccggcagctgagaaaatccagaagacggggcgagggcgttcacccccgcgcagtacgccgaagactgccgttgcgagtggaagaagtccaatgaagacaatggcgtgtgcggatgtgacatgctgaagcgctaaagctgtcagcaacgggaaaccaatcactacgccaaacgctaccactaataatgaaatgaggtctcttttggcaggatgctgctgccggaagatgagaaggagacctcccgccagtacaccagctatcgcagcacggcaaacggtgagaaataacggatcgaagtctgacacagccaaacgggtcgcaggcagcgagccgctgaaaatgagtacgcctataaaaccatttatccagccatttgttgttttgttcattataatcactccacatatctttcttgttcattgtctgtattttcttaacaaaaccagcagctaaggattacaatgactataaactggaattggccttttttaaacggccagttttcataaaaaaatgcataccagttaggagaacaacgtgcaaatggatatcacgccttttttgaatagaactctggatattccgctttatcagcagctttatcagtattttaaagaaaatatgcatcggggccgtattcaaaaaggaatgaagcttccttcaaaaagactcctggcgaatcagctttccatcagccaaacgactgtagaacgtgcctatgaacagctcgttgctgaaggttatattgtgagcaagccaagaagcgggtggttcgctgattatcatgattctgattttgcttatgatagaatgccaagcacaacacccattcaacaagaagcagaagaaaataaacaatggattgattttcattatggaaatgtagattcttcttacttccctttttccgcatggcgaaaaagcatggtcaatagcttagaccaatatggacacgagctttatcggccgggacatgttttaggagagtttgaggtgagaacactcattgcagagtacctgtatcaatctcgggggttcattgcggccctgaacaagtgattataggtgccgggaaccctattctgctgcaaatcttgtgccaagtttttgagccgaatatttctatagggtatgaggatcctggttatccaagagcacgcaagatttttgaagccaaccgcatgaatattgttcctataccagtcgatgatgaaggaatctgtatacagaaggtcaaagaacagcagccaaaccttgtatatgtcacaccttcccatcaatttacgctgggaaccataatgacaataaacagaagaattcagctgctcaaatgggcggccgaaaatcaatcctttatcatagaggatgattatgacggagaatttaggtacacaggacagccggttccttctcttcaagggcttgatcagcataaccgtgtcatttatatgggcactttttctaagtctcttttgccctcgctgcgtatcagctatatgattcttccttcacctcttttaaaaaaggggcatgaaatcacgtccttatataagcaaacagtgtcctgccacagtcagctaaccctagctgaatttataaaaaatggagagtggcaaaaacacatcaacagaatgagaaaactttaccgcaaaaaaagagccattgtattagaggcagtgcaaagggaattaggagagcatgtcagaatccgcggagaaaactctgggcttcgtatcttacttgacgtttatttgccatttggtgaaaaagagttaattgagaaggcgaaaaaacatggagtaaaaatttatcctgtttctctttcttatcaaaatcatcctcctacaaaaacggtctcgctcgggtttgcaggggtttctgaatccgacataagagaaggcataaaaaaactgaaggctgcctggaagatatgagggagctttcagtttagcaaaacggccaagtgacggaactaagtgttgagagctgttcaatattttttaagtatatgatgagtgccagcagtccagcccacgatatgtctgtttagcgaaaaacagaattttttatttgctcatcacagtgctaaaataaacaaaatagacaattgaaaaaatagaggtgtaagaatgaagttagatgagtttacaattggccaggtcttcaaaacgaaatcattaaaagtatcaaaagatgatattatgcggtttgcgggtgaatttgaccctcagtatatgcatgtagatgaagaaaaagcgagtaaaggcagatttaatggaattatcgcttccggcatacaaacactggccatatcttttaaactttggattgaagaaggtctctatggagacgatattatagccggaacagagatgaatcatatgacattcataaaacccgtatatccggatgatgaattgtttacaattgttgaggttcttgataagcagccaaagagaaatgaattgggaatactcacagtcttgttatctacttataatcaaaaagaagtaaaagtgtttgaaggtgagttatccgtattgatgaaacgataactcagaaagcccgcttttcgcgggctcgattgaagcagatgggtgaaagatgttagcgggtttcttttgaaaaataagaggttaaaatatcataaacaataggcaaagaagtaaacccctcattttctagaaaatgacccccgtgctggacttcgtataacgcagcgtcaatttgttgtgccagctccttgctccatgaaaatggaacaatttggtcgttcttagaagcaatgacagcacggtgcttcgcggactcgatgattttttgatgatcaaacgatccctgtgtaaattcatctaacatctgtaaagtgggcaacgatttggcaaagccggaaacaagtatgattccgccaagctgttttcgtaattgaatatgttccaaaaatctcaaaatggcagggcaccctaagctgtgcgcaaccaaatacgtattttcgtgtaaagtgtgctgatataaagagagtgtatccagccaatcctcaagtcttggctggagcggattaggcatgtttaaaatgtctgcttggaccccatctgcgagcagacgttttttcagccaagggaaccaatgatttgttgaggaggctctgtagccatgaatgatatagacttgttttgtcattatttcctcctaagaaatattttcattcagtataaaattcctctcattgggaaacaagtacgcacttttttgtaagtagctttatatatgaggcactccttgtgccattccccacttacacatctcatctatgagggggtacaaagatcgccctctgtcagataacgaatactctactttcagtggggtttgagaaacctcagaccgatgaataaggccgtcagtttgcaattccttaagctgtgcgcttaacattttatgggtgatgaagggcatagcccttttcagctcgccgtatctcatcgttttttcacaccctaactcatagagtattctcattttccatttgccccctataagagacaaggtgtattcaaatggggcttgtttactgcggcacaggctatccatgtaatcgaacctcctttttaaggtatcatatcagaataattcaggattttcggtgttgaagtttgagggcgattcgcgatctgaactgaaaggaacgcttgctcaacaggcggcacggtacatgaatgttctaagtcaaagagggttaccttactgttaattactttatttaaaaaaacgcatgtttttagctgaaaatatctattatggtatatttaaatataacgaaatatttgagaaatgaggaatggtatgaatacacccaaaaaacataagaaatttaaagcgaaaatgattctccaaatcatcatggttatcattggaggaatcatagcggcatatggactagaaacagtgctcattccaaacagtgtatctgatggaggagtgacaggtcttagcatcgttggttcacagctattcaacttgccgctggggattttgattgctgtgatcaacattccatttgtctggttaggatataagcaaattgggaaaagctttgcattattatcaattatcggaatcgtatcgcttgccgcggggacaagctttttccaccacacacccgctatcatagaaggagataccctgttaattaccgttgtcggcgggattatccttggattcggaatggggctggcgctgcgtaatggcggcgcattagatggaattgacatgcttgctgtgctgctatcccgaaaactgccattcggaacgagcgatctcattctattcttaaaccttttcgtgtttatttttgtttccacagtatttggcttacaaggggcattgctttcagtcattgcttactacattgcatccaaagtgattcatgttgtggaggaaggcttaagcggctctaaaacctttcaaattattacaacccaacctgaattaatggtagagacaatacgtgatcaattaggccgaagcgccacatataaagaagcttacgggggtttttcccacgagaaatttaaagaaatcacatgtgtcatcaaccgtttagaagaaaccaaactaaaggaaattattaatgatattgataaatccgcctttgtcaccgtatatgacgtagctgaagtgaagggcagcaattttagaagtcttaatcatcattaaaaaatagaatgacctttttaaccgtaattgacatgccgcgggtaatttaatcaaaaacactttttgaggcttgtgggtgaataaccggtgaaggtctgaatcacagaaataccaagggcgtcaaaacccttggtattttttctggttattagattttatcttcagctttacgtgctgcttcgagcttatcaatcctgtctttatatttttctccccagtccttcatgtgcaggataacaggttctaatgttcttccaaactcagttaaagagtattcgacttttggagggacctgtttataaacctcgcggtgaatcacgccatcccgttccaattctcttaattgtagcgtgagcatacgctgggtaatttttgggtatagttttcgaaactcattaaacctctttttaccgtcaatgagatgataaagaagaatgcctttccacttacctccgatgatatctaatgttgtctccaccggacatccttcaaagtcatcagaagaataatcaatgccgagtttacgatttctcaagctgttcactcctaatagtatactttttgatactatatacattcaatgtgcgtactttttatattttaatatacatcatataatgatgtcacatctaaggaatgaaaggaatggatcatatgaaaacactcgtactcgttgtacatccgaatatagaatcctctcgtatcaataaaaagtggaaagaagccgttttaagtgaaccagatgtaactgtccatgatctttatgaaaaatatcgcgatcaaccaattgatgtggaatttgaacaacagcacctcctggcccatgaccgtatcgtttttcagtttccattatactggtacagcagcccaccgcttttaaaacagtggtttgatgaagtgtttacgtttggctgggctcatggtcccggcggaaataaattgaaggggaaagagtgggtaactgccatgtccatcggttcacctgaacactcttatcaagccggcggatataacttgttttcgataagcgagctgacaaaaccgttccaagcatctgcccatttagtaggcatgacctatctgccttcctttgccgaatatcgcgccaatacaatcagtgaccaagaaattgccgaaagtgcgaatcggtatgtaaagcatattacaaatatcgaattaaacccgaaggttcgcctgcaaagatatttgaaacagctggagggtgtcgatttaacataaagattgattttggaaaatcctgtactcaccaagcaggattttttcttgttcagcagagggattttaacatatagcgaaaaaagaagaagccaccaaaaataagctatttgcttggtcctgactgcttatttttggtgaaagacttatttctctgtgatgaaataaagcaaagcgatgaccggaaaagcgattccaatccataatgctgtactccatccccctgaggcatatgcccatcctccaattgatgaccctatcgcaccgcctagaaagaagatcgccatgaataatccgtttaatcgactgcgaatttcaggcgccaacgaaaaaatagcacgttgactgagcacgaggtttgcagatacacccatatctaacagaatagctgcggccactagaactgttataccgacgggggagctgctctgaatcatgagcggcagtaataaagagacaacgacaacaccgagagcgattccagtggcaagccgggtcaagcctcgatcagccagccggccgcctattggtgcagcgactgcacccgcaatgcccaccaatgcgtagagtgctattgccttctgagaaaaatgaaaatcaggaccggacaataataaaggaacggtagtccagaacaagctgaaagctccaaatacaaacgcatgatagatggcacggcggcgtaagattggagtcgtgcgcagcagcttccaaattgaaccgagtaaggcagtatagtttgtatttgctgttggttttctggcaggaagcacttttgataatacgatggccaggataacacttaccacggcggacaaagcgaatattgcattccacccccagatatcagcgactagactagatatcggacgggaaagcataataccgagtaataagccgctcatgacattgccaacaacccggccgcgtgcagcgtctgatgcaaggtatgatgcaaatggaacaagcacttgggctgcgattgatcccaatccgacgaaaaacgcagctgctaaaaacagtgttccatgcttcacaaatgctgttagtgtcaaagccgctgcgcttagaaggagcgatacaacaataagttttttgttttcgataatatctcctaaagggacaagaaataataagccggcaacgtatccgatttgggtgagtgtgacaatcaatccagcactgcttggagaaagtccaattgccttactaattaatccgaccaagggttgtgcatagtaaagattagcaacaatgataccgcatgcagttgcgagaagaagggttaaactgggtgaaatcctctgacctgcttgtttgtttccattagccataagaatgaactcctttttaagtggttttttgagtgtaatcatgacttctcaacacaagtgattttataaactgaacgttcagtttcattgattaaggaaaataatatactaaacgttcagttttgtaaataggtttctgttttctttttttattcagattaagtatactgaacgtatagtttatattgcgggaaggaatgattcatgtgcagagtaaacgagggcggccgcgtgatgaaggaacgcataaggcgattctctctgcagcctatgacctattgctggaaaaaggcttcgatgcggtgacagtcgataaaattgccgagcgtgcgaaagtgagtaaagcaacgatttataaatggtggtctaacaaggctgccgttatcatggacagctttctttcgaccgcgacggacaggctgcctgtgcctgatacagggtcgtcagtacaagatatagtaacccacgccacgaatttagctaggtttttgacaagccgggaaggaaccgttattaaggaattaataggtgcagggcagttggatgaaaaattggcagaagaatatcgcacgcgatttttccagcctcgccgcctccaagcgaaaggccttctagaaaagggaattcagaaaggtgaattgagagagaatcttgatattgaagtaagcatagatctcatttacggaccaattttctatcgtctgcttataacaggggatgaggtgaatgattcctatgtgcatgatttggtgatgaacgcgtttaagggagttcaagctacctctgctacagagagtatgtagctgataagaactgcaaaagctacggattatatgacaaattggttccatcgtacgtgaaatataagatttttgttgctgagcggaatcatcgagggaactcttatcggatgtcgaaaaagaagtcattcaatcgtgaatacataacatcatattattacatttccttttcatcgattggaacaagggttctatacttcaatggaatatcgcaaagttggagtatttaaagaacaggggaaaatcgatggccattatgtaggtgtcatggcaatggaaaaaatacttgcaatgtaaacaggcctctaaagagacctgttttttaatatccagaggatctgtctattttcatcttgggctctatgactactcccataactgaaatagtctaatatttataccggaatatttgatgttccaaatataagggattgtttatataaataaaagtttatataatgacgggggcgctaaggaaacgcggggagcgactcaggttttcgtttcaaagttttgatccttaagatatacggagcgctacatatggaaacgtaaaggggaatgtataatcatttggcgtgtatataacgatttgcttatatattgatttgggaaggaggagctcatatgacgattgatgttgcggcgatgactcgttgtttgaaaacacttagtgatcaaactaggcttataatgatgagattatttcttgaaaaagaatattgtgtctgtcaattggttgatatgttggaaatgagccagcccgccataagccagcatttgcggaaattaaaaaacgcaggttttgtgaatgaggacagaagaggccaatggcgttattattcaataaatggttcctgtcctgagtttgatacattgcaattgatcttacatcaaattgatcaggaggatgaattgttaaaccatatcaaacaaaagaaaactcaagcgtgttgccagtaaggaggcattagattgacatcaatgattttggcagtattcatctttttattaactctagtattggtcatatggcagccgaaaaatttatctatagggtggtcagcctgtggaggcgcagttttagctctaatagcaggtgttgtcaattttcatgatgtgttaactgtgacagggattgtttggaatgcgaccttggcttttgtggccatcatactgatatcgttaattcttgataatatcggtttctttgaatgggcagcgcttcatatggctaaggctgcaaaaggaaacggtgtgcggatgttcgtttatgtatctctattaggagctatcgtcgccgcgttatttgcaaatgacggtgcagctcttatattgacaccaatcgtattagcgatggtcagagcattacattttaatgaaaaattagtttttccttttatcattgccagcggatttattgcggataccacttcgcttcctttagtagtgagcaatttggtcaacattgtttcagcggactattttcatattacgtttattgattatgcatccagaatggttgtcccgtacctgttttcgctgctggcgagcatcattgtactttaccttttctttagaaaaagcataccaaaacgctatgatctgactgaggttaaaaaacctgttgaagcaattaaagatcaaaacatgttcagactgtcatggtatatcttagggctgctgttaattggatattttgcaagtgaatttttttctatccctgtatcagtggtagcgggcagcattgcgatcattttcttaatcgctgcgcaaaagagtccggccgtccatactaagaaagtggtgaaagaggcgccatgggctatcgtattcttttcaattggcatgtacgttgttgtgtatggtgtccgaaatgccggattaacggatgtcctttcagatgtgattcaagccgcagctgatcaaggattgtttgctgggacaattggaatgggctttattgcggcgattctttcttccattatgaataacttgccgactgttatgattgacgcattggctattgccggtacagatacacatgggatgatgagagaagcgcttatttatgcaaatgtgatcggttcagatttagggcctaaaataacaccgattggttccttggcgacattattatggcttcatgttctttcgcacaaaggtatgaagatttcctggggcacgtattttaaaacaggaattatcctcacgatacccactttattgatcacacttgtcggcctgtatatttggctgctgataatccattcttgtttctaaaaggacaaggtcactatatcaaggaaaataatgcactggtaactcttgccgcagccagatggctgaagggtgggggagaaaataccttggggacaagtggaatgtgtacagcgcaggaatcgaagctcatggatgacatcgagtgctgtcaaagcaatgaaagaagcagggattgatatttcaaatcaaacatcggataaatttgatgatccggcaaaagcacacggaacagaagaagtgtttccaaagggtatgtgatgaaattggtgaccgtttaaaacagtttgctgtaactggggaataagaaatcgatatactcagcgtttccttgggtttatataatgcaatgtgttgttcaacaggtgtctgcgagctgagtgcagacacctgtttttatttgtctgagattcgtaacagggaagttatttagctggtgacagaggaaaattgatttgtgaacagaatcatgaaggagacggtgttttaaaggagttgtctgttttgcaggaattaacaaaagaaaaatacagtagcttaaaaacaatgtttgatgacaaatattgtcccacatttgtctattcaatattagaccaaaccattccgggagctgtttatgcagatgatcaaacctttcctaaatcgttttttataggaactgaatcaggcatttattttattgcgggagaccaagggaatcgggattttcatgatttcattgcaggatattatgaagaacaagtgaaatcatcaaaacgatttaccttgttttcttccagtgatacatgggatagcgtactgaaacccatactgaaagatgacttgaaccaaatgagaagagctgcattttcttatcaaccaaaatctttcaaaaagactttgcaactgccaaaggggcttgtattgaaaagaattgacgaagacatcatttcacacagcacagcgtttaacagcgcgtattatgaggagtattggaattctgtctcacagtttgcttcaaaaggttttggatttgccgtattacatggcaatcacgtagtaagtgagtgtacctctatatttttagggcataatcgagcggaaatggatatctatacacttgaagaatatagaggactggggttagcttattgcgtagcaaataggtttatagcgttttgtatggaaaatgggattgttcctagctgggattgtgatatttgcaacaattcttccattgcattagcagctaaactagggtttaagaaaataatcgaatactctcttttttattccggtaaatcataaaaaagagaagaggcaagaactcttctctttacatgagtaagcggttggtgaataccggtttttattttattaagaatctagatttaattgctggcgaagtttcttcgataagtcctttctcgtttcatcagttacaacatgataccataagtgatctatctttttatcctcaccttttatttcgatctgtttgacatgttgaacggcttctttataagagcgttgaatatcaatcattttatcaagtgttaagtttgtttgtatatttttttctaaggcagccaaaattccttgatagttttttaatgattttaattgtgctccttcgtgaataatttggttaatgatttctcgctgccgctgctgccgcccaaaatcaccgcgaggatcttcttttctcatccgtgcgtatttaagggcaacctttccatccaggtgctgttccccttttggtatatgcaccccttcaagggtaaaagggaaatcattattcactgtgattccgccaatctcatctacaatatctttaaacccttccatattgactttgatataataattgattggaatgtttaaaaattgttcaacggtttgaacggcaccttcaataccctcgtaagtatatgctgcgttcattttaatattggtattctttgatcgcataaatactctggtatcacgcggtatacttacgatcgtcgatgttttcgtctctggatttaaagtcagtacgatcatcgaatccggccgtcctttatcaccggggcgctcatctactcccagcaaaagaatcgatataggatcatgtccaagactagcatcttgttgcttagaatctctttgcagaggttcatacatatggttgaccgattttgctacgtttcggtaaatgctatagcaggtcaggcctccaatggttaacaagagggctagaacaaacaataaaatactctgcattttcagtttccttctcccgattttcactatcaaattcctttctgatcaagttgaatatttatatgttgtactggttcttaacggttctctaataaataattcttttatctccgtgatattttgtagttcatataagatactttaaatttatacttcaattgaatctgaattgtaccggtttgattgaatcatgaattgctttcatttcgtatccgctttcccggaaatattttaataattgttccaaatacgccgcggtagttggcttttcatgcattaatacaataagcggctcttttccttcaagggttttgacttgctgaatgacactcttaacaaactctccatgagtgtacttccagtcctctgagtcaaccgtccaatcccacaggttaaaatgatcacgctccacaacatttctaaaagggccagtaatgtaaggctttgacccgtaaggtgctcttattaaatgcgtgttgactttggttgtttctttaatgtagtccaatgtattgttcatttctgcagcaaagctttcaggggatttatagatttcggaaacctggtgcgtcacgccgtgagacccaacagaatggccgttttccgccatttttctcacaatattaggatttcgctcgatatttggttttaacataaaaaacgttccctttgcattgtatttatgaagcaaatccataattttctctgaagcagcagggtttggtccgtcatcaaatgttaaataaacgaccttcccgatttcagcaggttttttttgttcttttttctgtgctgaatttttgtgtgtttctatatgcgcctgctcagaagcgtttgtactttcttttattggttcctgctttgggccggcaagtgccttccaggaaatgcatagtaacgttacacctagaataatcaatatcccaaaacctatttttcctatttgattcaacttacgatcccttcttggtgaatttgacactttttccaactcctcaattgtagatatcaaaactagttttctcgcgaacgagtcacataaattagaaggccaatgaaactttggagacaaagcccgataaaaatgatgctcttttaatatagatgagagttatcgcagaagtttgatcaatttgtaaacaaaatgtcaacaaatgaaggaatcattgttatgtaatatcttgcaggtataagaaaaaaccttatttctattcaatagaaataaggtttacttgaaggatatgatataagagcgatcgtcaaaaaatcgggctgatgagttttccatagaagtatactggttttgttcataaacaagcaggttgctgccatctggactccaatatatttctgatgggctggtgccgtggtatataggttctgcgtagaggacatttttcccttgcagctttcctgcataagtattgtccttgtcatataaagagtaagcgatcttctttcgatcattagatatggtaaaaacagctacattttcgagcagaacagagagctcactgtttctgaggtcgtattcgtataaggtttctccgatacctaaaaatacaaattggtcattgtttaaccaaacaggtttaccataggggctaatctgccgcttattttgaatagtgatgctgtcaccgctgatggtccccgtcataatgcggtattgttgcccttgtaacatggtaagcagcaaactgtgtccatcatctgaaatggaaactgccgtaagcgaatccttttcatcaacattcttcaatggatacgttttgagggttccggaatctatgttgaatacattgaccgcagtctggtcattttttgcagtgtcaatgacaagataacaaatgtatttgctattatttgaccatgaaatatcctgtacaaaggcatccttgttagaagaaaagctggctacttcctttttgtttctgttcgtcagtgatattagatttagtgttatcttatttgatgacatcgttaatccggcgatacttttcccgtcgggagacaacttaaggttggaagtattgcggtcaatgttctgcagagtttcaggtttttcaaaaggataggagacattctgaagatgctgcgctttaccttccgttgtgtcatttcctttgaaaaaaccaactacagagtttgatgaagaccagccaagcaactggtcagcttgagggaggcgatatatcttcttcacctgaaaggagcctgacttctgatcgtcatcaatctggctctcttccttgtttggaatgataatggtttcagatcgcttgcccatattatagctggatacaaaaatcaaggaaatcaataatatccctgacaatataataaaccgtttgttcttcatgatcatttctcaaccttcatgtaagctagttcaatggtgatgattgtatggttttcttcgtagaacatcttgattgttcctccatgtttttcgacaattgttttaactatgcttaaccccaaccctaaacttccttcttccgtcaccttttggtttattgaataaaaaggctgaaacacttttgtgtattggttgtcgtcatatggatcacttggatttttgaacataaaaagaacctgatctcccgcaactttagcctgaatcatgatttctgaatgagataaactgtatttgatcgcattgtccaaaagattaataaagagttggcgcactctattcttttgaccatacacatagagactgtcttctatctcataggtgatcttctttttatatcgttctgcacgaaatttcatagattcgcatacatctttcaaaatcgttcctgcatcaatcctatcgaattgttctttagaggtttctctagatacctcaagaagttttataaccaaattgtgcagacgccggctttcttcaacaatatgattcattcctttattaaaaaacgcctgatctgattcccctttttgttttatgatttcagcatagccttgaatagaagtcagaggtgttttcagttcatgggtcatattgtcaaaaaaacgtttttcctgttcattaagttcctttaacctgtcccgatctttttcgatagttgaaatttgatccctaattctggtgatcatatcattgaaattaaccgtaagctggccaatttcatcttttctagaaaaatggatatccacatccagctttccctttttgacttctgaggtggcctctgtcagcttgacgattggaatcgtgatgtgtctggagagtatataagagaaaagaaacgccgccacaaatatcgcaagagcgatataaaaaataatatttaaaatctctccgctttgtttgtaaagcaaattaaaatctttagaaaaacgcaatatgccaacttttgcaccatcaatgacaactggataagaaaaaaacacctgtgcttgatttcgatcataggtgatatgataagcattttttccgttaattgcttttgctaggtcatcgtcaatgccttgtgaaaacattgttttattagaagaagacaacaaagtgccatctacggtataaacgcctacattgctttctgttgaatgagttaaactatccactatttcatcggccatatcgccgaagtatagttcattgtttttataatgattgattaaaaatgcttgattgatatacacgatgctgtttttttttaactctattaaatctgaggttacaattttttcattgcttgaccaaatgacgcttttgaccgtttgattgagtactaggaaagagagagaaaaaatcagaaaaaaaccaataataaatttacccttgatcgtccgtaacactctctactcctcctgcttctcgaatttatatccaatgccaaacactgttttaatgaggtcgcttgcatccagttttttacggagtctttggatatgagtatctaccgtacgtgtatccccggcaaaatcgtagccccaaacaaattccaacagctctgaacgtgtaaagatttttccacgatggtcaatcaatgtcttaagcagatcaaattctttaggagtcaaatcaacaatgatcccatctttttttactattctttcgtctgggatcatcacaatattttttaattgaatgtgatcctcattagacgatcctcgatcattcacgtggttagcttgttcaagacgtctgagtattgtacgaattctggcgataacttcacgcaagtcaaatggctttgtaatataatcgtcagccccaaattccaacccaaggactttatcagtgatatctgactttgcggtgatcataagtatagggatattatagcgttgggtcacttttttacagatatccaatccgctgcaatctggcagcatccaatcaagcagcagaagatcgggtttgaattggtttagctgtttcatccctaaagctccgttagattcagtacacgtttgaaaaccttcctgcgtaagcccgtatgaaagcagatctgctattgcttcatcatcttcaataataagtattttcgttttatccattatttcattcattccctgtttcatgattaaattgaatatatctatcttagcgtctgcaatatcactcattatagcattctttttaatagtgattattcagaacttcagaccaaactataattggatatattttcaccatcgtcaacaaaatcgggggaattgagctatcgttggattagaggactatggtaaacaatgcaattttaattgataaatgagcttattaaaaagataccaaatgatgcgggtatcttctttatttatgtataagagcgtgtccatatcgtttgattttattgggtgttaaataggtaaaacataccccgccaactgtaaccactccgcctagcagagagatcagtgtgggtatttcgccgatccagatccaagatatgatcaaggctaaagccggtgtaacataaagtgaaagggttgcttctgaagcaccgacgagtgaagtgacatatgctagtgcgaagtaaggaataaccgtcggcaataatcctaagtaaacgatagacaaagttgcgcttattgaagcgttcatcatctcttcgcctaagcctggcagaaacacaagcataggtattgttccgccccaaatggtgaatgtaacgaatggaataaaaccatatttttttatatagcgggcttgaaaaacgaaataaatactctccgaaaatgctgccagcaggatgaccaagataccgctcattgaatatgtaaagtctcccgccccaaatgcaatcaataatacacccaataaactgatcatagagccaagccatttcgtaaatccaaaatgctctttataaaacaggcgggatagcatggctgagaagatcggtgccgtagtaacgagtaagcttgcaactccggcactaactgttttttcaccgatgttcagcaaaatgtgatagagtgcaaatcctaaaaaccctaaaagaaaaatggcaggaatgtctttcaagtcgggtaggcgcatctgagtcaaaacagcaaaaagcaataatgccatagagccgattaacaaacgacataaagcaaggtgttctggtgtgtacccttctagtcctgcgcgaattcccggaaaagcagatgcccataaaccaatcatgagactatgagatatcattatttgaactgttttctttcgcattcctctcactcctctttacaaaaaccaaccagttatttaatgtgtttttatattaataaagatttggtgatatagcttcaaccagttaaacggattttgacccaaccaatttattttaaggagaccgattctatgagctttccagaagaaaaaaagatgaaaaagctccctaagtacagacaaatcgttcattttattaaagagaaaataggaaatggagagtggccgattggaagcaagattccaagccagcgcacgcttgcaaaagattttcaggtaaatcggagcacagtgattacagccttagaggaattgatggccgatgggctaatagaaggcacaatggggaaaggcacagttgttatcaacaacacatggacactgatggctaagaattctgctcccgattgggatcgatatgtcacctctggtattcagatgccaagccgaaaaatcgttcaagagataaatcaatcagaatcaaatacagaccttatacagctcagtaaaggtgaactttcagctgagatttttcctttggctgttatgaaagagatgatggggaaggtatctcaacacatggaggcattcggatatgaagaaccaaaaggttacttacctttgagggaggcattgagcaactatttaaaaaccattggaatcaacgtctcatcttcttccattctgattgtctcaggagcgttgcaagccttgcagctgatatcaatggggctgttacaaagaggatcaaccgtttatcttgatcagccctcctacctttattcattacacgtatttcaatcagctggtatgaagctgactggacttcctatggataatgaaggacttttgcctgaaaatgttcatttaacaagaggagagcgtggaagggctatcttatatacaaatccatgttttcacaatccgactggtattcttatgtctaaaaagcggcgggaagaaatcctagcagtaagtgagaatacacagcttcctattattgaagatgacatttatcgtgagttatggatcgatgaaattccgccatatcctattaaaacaattgataaaaatggacacgtactgtacataggaagtttatcgaaaacattaagcccaggcttgaggattggatggatcgtcggaccggaaccggtgattgagcgtttatctgacattaaaatgcaaacagattacggatccagttctttatcccaaagagtagcggcagagtggtttacttccggccaataccagcagcatgtagaaaaggttaggcagcaattaaaggtgagaagagaattggccttgagtgttttagaaactcatttgaaagatgtggcgacatggaatatcccaaaaggaggattttttgtctggataaaaatattgccttccatatcaatgaaattactttatactaaagccttatcaaaagggattctgatcaatctcggcagtatctatgctcaggaaaaagggaattatattcgcttatcatatgcttatgcatctcttgaagaccttcaaaaggggatttatgagttgggtttaatgataaaagaactggcaagtaagtaacttttatatccttaaatggatgtttcactaaaaaagagatcaagcctaatgatcgcttgatctgataataacaagggttactagaatagaccaaatcatggttcggtcttaaaatgatcatgtctctgaacgaaaagtctttccgacttctcttcctaaaccaaagtaatgtctgaaattatagataagcgggctccatttggaagggttgatatggttttcgtctagtataatactttcctcggcatgaaaatgtagtgcctgcgtctctacaattgcgaatgacgattcatattctggaaaccgaatgtgtttcacttcggcttctatttgaataggacattctttgattcgtgttggtgatactgtttttgattgtaaaggcgttaaccctgctgcctcgtatttttcttttttatatgtaaatccgagctgtttcttcaaaggcggtatactcttttttccgctataagatgaaattctttcaacgttttcccataattccgggccaggcaagtttatgacacattctttgtgtctttccaaattgtcgatggcttttcctcccagtcctactccaaggattatataatgtccaagagcccaagaagaagacataggactaatattagtggttccatcctcattcaatgtggttagaagaaatgtcgaggtaccataatacatgatcttgggttttatttctttaaatcgacgagtgtctcgttttttgatgtccaatgttttttcctccttgtcacgcttacatttatattgtaaaggattaacatttcaactatcatcgaaatatgaatgtaaggaggaaaatcatgaatcctaatattgcaaaaatctcttcgttgctatcagatccctcgcgttcttccattcttctcagtctgatggatggaaggatacaccctgcgggagagcttgcatatctcgctaacattaaacctcaaaccgcaagttttcacctgaataaattgcttgaagcaaagctgattagcgtagagaagcatgggagacatcggtattacagattgtctgactcagatgctgcaaatgtgatcgaacaattgcttcatattgcgcctaaagcaaaagtcaaatctttaaaagagtcaaaagagaaaaaggacttgcatttcgctcgtacctgttatgatcatttggcaggttatgtgggcgtgcaaatggcacattcattagttgagcaggggatgttaaaaaaagttgatttaaactttgaggtgacttcagagggtgctttattcttttcaaagttaggcatcaatgaagagcaacaacggaataagaggagagcttttgcccgctgctgtttggattggagtgaacggcagcatcatattgcaggagcattaggaaacgccctattggtgcgcatgttagaagaagaatggatcgttcgtatgcctaaaacgagagcgattaggattacacaaagcgggaaaatcgcgtttgaaaagcacctaaacgtgaagatttaggactttgaagcggaaacaccagatgatgaggcacgatatctaggaggagtaagatttgttctaatcttactccttcttcttattttgaagcagctcgattccccattgcaatagagatgcggttccaactgtttatttgattaatgatgagaacaaggtcaacatattgtttttcatcataatgttcccgcacccgatgatatagctcatcaggaacccttttagatggaatgagcgtgatgtgttcagatagttcgagagccgctttctcttcaggtgagtaaaaatcacattcattccaagcatgtaaacagtaaattcgctgttcagtttctcccattttgcgggcatcggacgtatgcatatctatgcagtaggcacagccgttcatttgagagactctgattttgattagttctctcgtcgttcggttaattgaggattgtttcgtgtatttctccatatccatcatgattttcataccttcaggtgcaatctcatagtaggacactctttgactcataaggcaagactcctttccatagaatacctagattgtatcccggtattgatcattttaccaatgtgcggtttgaatgacagctgtttcagcgtcttttggaaagaagcttctttgaataaaaataagggtagccagcaatgatgagtggagctgctaatgcaagcagtatccatgagcctgattggctgtctctagtgactctaatgaatatataagtaccgatcagaaaatataataaagcacctagaaaccaatacatgttcaatcctctttttccttactttttggttgcgcatttttgtctgtcatatggcttaatcgatcagggttctgattttttaataccttttcggtccggattccttttctctttaatgataaaattgtgagatcaatcgatttcaatgatgatcattccttcaatgaatagtaagttccttatgattttaaaggtaaatttgaaaagataaaacgtacatagaggcagaacgttcatgtacgtttgggcaatgatcacttgttggaaactctaatgtttccctgcacctgatattgttgtgttccttctcttcctataaaatgattggatacatgtgtgtttgcacgttgaaatatgagttcgattttcatgaatctctattcggtgaaacaggtaaaggaagtggataaggtttgcttataaggaatccttttaaagataaatattactcacatgataggcgggcattaaacatgcttgcactcagagtgccgggcctggcttttattctcatgatctatatagcctctatcgtgctgcaatttgtttctgggggctggtccattttattgctttatgcgtttaccatattaatcgccatttttgctttgcttcattggcactcatatcgctgggttaagaaaagggtggttctgtattttgtgatacaaggtttgatcacctttacacttgctaatctcatgactggctaccttatgctggtcatcattggcctttatgcatttttgattggacagattttaggaatggcagacagaagaaggacgattcccattctttatctattgctgctgctggtcataaattcggcgtatcaccttcataaaggtgaagttttgcattttattgttattgctgcgccgatcatgattgtcatcatcacttatgccgcaacattttttgcccaagtcgatgaaaaaataaaagctcaattgactcttgaaaggctggagctggctcatcagcaggtagaacagctgacgctgcagaacgaaagacagcggatggcccgagacttacacgatacgcttgctcaaggtcttgtcagtttaaatatgcagctggatgcgattcatgttcatctcgccaaaggcaacacagagagagcgaaggaaatcatacaacaatcgatgaaaagagtgaaaagcacattagctgatgcacgttcagctattgacgatctccgcagcaaatcagaagaaatcggtgttttaaaagaaagaattacctcgctaatggatcattttatagagtcgacaggcatggcttgtttattagattacagattgcatcaggtgctggatgtgcgtacagctgaaaactgttattacatcattggagaatgcatgacgaatgcggcaaagcatgctgaggcgaaaacaatctggatatccatttgggatgatgaaaagggaaggctccatttaacagttaaggataacggcaagggatttgatgttgaaaaaggaaagaaaaagagaggacattatgggcttcttggcatacaagaacgcgtcagggcaataaatggccaattcaatatcaagagtacaaaattgaaaggaacacaaattgagatcactgtaccaattcagggagagatgcaagatgaataaggttttaatcgttgatgaccatcttgtcgtgagggaaggtctgaagcttttaattgaaacgaatgatcaatacaccattataggagaggcggaaaatggaaaagtcgcagtccgtcttgcagatgagttagaaccggatatcattctgatggatttgtatatgccggagatgagcgggttagaggccattaaacaaataaaagaaaaacacgatacccccaccattattttgactacatataatgaagatcacttaatgatcgaagggattgaattaggagcgaaaggatatctgttaaaggatacgagttcagaaaccctttttcacacaatggatgcagccatcagaggaaatgtgctattgcagcctgatatccttaaacgtctgcaagaaatccaatttgagcggatgaaaaagcagcgcagtgagacgcagctgacagaaaaggaagtcattgttctaaaagcaattgctaaaggtcttaaaagcaaagcgattgcctttgatttgggcgtctctgagcgaacagtaaagtccagattaacgtccatttacaataaattaggcgcgaattcaagaactgaggcagtaacgattgccatgcaaaaaggtattctgacaatagacaactaaactgcatatttgaaaattgcccaaacgtacatgcccgaatgtacgtttttttcatttcattgtcaactacaatgagaaagaatgtgatcaagcaatgtgttgaaaggagattatcatgtcaaaaatgttatatacattaggaggatgggttgctcgcaatcgcataaaagcaatatgtgcgtggatcgttgtgttagttgctgcgataggccttgcagtgaccttgaaaccaagtttttctgaggatatgtccatacctgacacaccttcggaaaaagcgatggatgtgattcaaaaagaatttcctcatggtcctgataaagggagcatacgggttattttcggtgctggtgatggggagaaacttactgggaagccagcaaaaaaagcaatagaagatacgttcaaagaaatcagtaaagatgattctgttgactcgattgcaagtccttttgtgacagggacaatcgcgaaagatggcacagttgcctatgctgatatcaagtataaatcatcagcagatgatgtaaaggattactctatcaaacacttaaaagacagtttgaaaatggctgatgatgaaggattgcaaactgagctgagcggagatgtaccgggagccgagatggagataggcggtgtctctgaaattgtcggcattatcttggcttttgtcgttttagccattacattcggttctttattaatagcaggtttgccgattttaactgcactgattggtttaggtgtaagtattggactggttttgattgggacacaagtatttgatattgcttccgtcagtctttcattagccggaatgattggccttgctgttggtattgattatgctttatttatttttacgaaacaccgccagtttttaggcgaaggcatacaaaagaatgaatcaattgcgagagccgtgggaacagcgggaagcgcagtcgtttttgctggacttactgttatcgttgcactttgcggattgactgtcgttaacattccttttatgtccgcgatggggctgacagcagggcttagtgtactgatggctgttttggcttcaatcacacttgtgcctgcggtcttatcgattgcagggaagcggatgattccgaaatcaaacaagaaaatagaaaaacaaagcactgaaacaaatgtctggggacgctttgtcaccaaaaatcctatcatgctaagtgtatgcagcattctgattttgatcgtcattagtatcccatctatgcatttggaactgggcttgcctgatgctgggatgaaagctaaggataatccggatcgccgggcatatgacttgcttgccgaaggctttggagaaggatttaatggccaattaacaatcgtagcggatgccacaaatgctacagaaaataaggcggaggctttcgcagatgcagtgaaagaaataaagggtttagaccatgtagcaagtgtcacccctgcaatgcctaataaagaagggaactttgccatcattacggtcgttccggaaacaggtccaaatgatgtcacaacgaaagatttggtacacgatgtacgcagtttgtcagataaaaacggagtagatttgcttgttactggatcgactgcagtgaatattgacatttcagatcgcctgaatgatgcgataccggtgtttgctgtacttattgttggatttgcgtttgtattgctgaccatcgttttccgttcgctgcttgtgccgcttgttgctgttgcaggtttcatgttgacgatgacagccactcttgggatttgtgtatttgtcttgcaagacgggaatctcatcgactttttcaaaatacctgaaagagggccgatactcgcgttcctgccgattttatctattgggattctgttcgggttagccatggattatcaagtattccttgtcagcagaatgcgtgaagaatatgtaaaaacaaagaatccagtacaagccattcaggctggattaaaacacagtggtcctgttgttacagcagccggcttgatcatgatcttcgtttttgcaggatttatctttgcaggcgaagcttctattaaagccaacggattagcactttcctttggtgtgctctttgatgcctttattgtaagaatgacactgattccaagtgtcatgaagctgatggggaatgcagcctggtatttgccgaaatggttagacaagatgattccgaacgtggatatagaagggcatcaactgacaaaggaaatacagccggaaatagatcatgaacaaaagaaacaaatcagtgtgtaatagaaaaagcagatctttaatgatctgcttttttgcttactattcctgatcaagctgtaaacgattttatagccgaacattgtggtggtatttggaaagtgaagtcggtacttaaaaaggagacacttatggcgccatcactcattttcgatatggatggaactttgtttcatattggcggaagctgcgtcatactagcaggcatcccaggagaagtgataaagcatatcaaatgatttttttgacgctgccttctctccatgatgcctaggttcttgataattcttcttaagaataaaggattttacaactgattatataagaaacctaaagaaacaagcacacaaaaccagctgcgggttttgtccaagaaaaatagagtccataagagggactctattttttgaaatgcccggctagaagcatattgcaggactttatgaatgcaaatcactatcttataagcccttaccgtgaaatgcctgtttctgcattgaaaaaacgcattacacgttcatttacgtaagcgggttgttccatcgataaaacatgtccggcatttttaatgacttccgcctcaatatcaggaacgaatgaagaggctcggtgcagggctgagtggggatcatagatgacttcatgttcaccaagtaataataggataggaactcttgctgaacgtaattcctcatcggtaaaaacatacggaaatccgtcggctttaggatttggatttcttgatccatcctgccacattacccctgcctgaaactgcttcacaaaaatcgggtgcagcacattctgatcattcatcatccaatttaagaatttttcaactccatttgacgctgtaaggccaagagcgtatttgtagaaatcgtgatgaaatggcaaaaacgtttctgccggactcagtatagctgcgctttttactctctcaggcatacgtaaaaggaaattcatcgtatggagaccgccaagcgaaagtccgatcatgtgggacttttcgatccccagattgtcaaacacatcaagaagccaattggcgtaatccgttcttgtaccgcttaaattctcaggaatactcttgtttttatcacctatgatatcaactgcataagttctgtatttgctgctccaatcggcgatgttgggataccacatcgtcgagctgaataatgctccgtggagtaatacaagcggcggggcatcctctgggccgcttacaatcacatgtgtttgaccaaaacgagtagatatatagaatgatttgcaacggaccggccaaagactaaggctttcattataagtttgataatagcggataccgttgtcacttaattcgggaatactagatgaatggtttgacatacaaatgcccctcccaattttgtttaaatgaatgtgccgtttcgtgatggggaatctgattttgatataacagactttatttacaatataatacagttgttgttagacgtcaaatccaagatgaaaaggaaataaaacgattggaacagattattgaaaatcaatataacagaatattaacctcctttgtggagccgcttcattaaaaccgcaatccaaatgcatgaatcacaaaaatcacaacaggagggatcaagagggaaggcagcaaattcaatgttttgaacttcttgattccaagaatgcttagacctgaactgaggatgagtatgcctcccacaattgtgatttcattaataaggtctgtattgattgcgctctccattactttagcaaataaatagatggagccttgccaggcaaataatacaatggctgcagccgctattccaaaaccaaaagttgaagcgagcacaatggaggtgatcccatctaacatcccgtttgtcaggaggtatgtataatctccatgcaaagcggcttcaacagggcccaatattgacagcgaacctatacaaaataataagaccgcagtagataagccctctgctaaattacttttagaaaatttgttcaccagcttgttgaatcgtaattctaaattgatgatctggcctagcaaacctccaatggctaaactcacgatgaatagaatgggatatttactatcaggcaaatgctgtgtaatggcgttgatccccagcgcgactgcagcgaatcccattgcctgcatcaaaatatcctggtattcatctttaatgccttttttgaatatcccccgattatgcttcctgcaatgatcatcactgtgttaaaaatcgttccaaacataagctttctcctccaaaaatcattcctgcataaaaaataaaccctctagttagtagagagtcaagggagatcaaaacatattcatgagattatttgatgggcagcaggatttcagtcacgtaattatctaggttattcgtaatgccataatcaatgagtgtgatttcgattgagtcccctgctacttcataatgatgttctttcatatatgccagtaattttttgtagtatggttcggcttctggatgtgaccctttaaacctaatttgcagatattctcttgaaggaaagatgatttctgaagaagttttttcattttcatcttcaagaatcataaatatactggaatatttgtcaaactgttttgctttcacatttgctgcagaaatggataaaccgatcttgcctatgaatatatcttcgtttacattcaggtgggttctcaattcagctaacgaatgttcgatatcatggccgagaacatattcatgctgcaagtaagccacacgcattgcgggaagtttgatttttgaaatttgatgtaacggcatgttaacggcatcttctatatgtgtgatgcgtcgggagatctttcgttcgatgcgttccaattctttctttttgcgatcaatttcagcctgctggctttttagtaaatgaagaagagtgtttgtattttgagagttataaaaatcaagaagcttattgattggcaggcctagggccctcaaatacttgatggtatcaagccgctcaaactgttgggtagaataatatctatagttcgtttgctcatctttatattccggtttcaaaaggccgatttcatcataataccgaagagcagagattttcacattgaataactttgacacttctccaatcgaaaaaaattccttcattctaacaacctttctgtgcctatgattgatatacacacattatatagtacggcgagttctaaaggtaaagtttgcatcataaagaaaaagctccttctaaaaaggagcttttcactcttcgaaataaggatttacatggatgagcacttcttctacatctgaaaactgtcttttgatttcatttcgaatttcgcgggcaatatcgtgtccctgcttaattgtcaaatcatgatccaaagataaacggacatcaagcaatttatagtggccatgttctcgcgcgcggattctatcaattcgttttacttgatcacattgaaaaataacagctttatattcctctatcagctcgggatcaacactcttttccatgagcacatcaacagacggcctgattaattccattgaaatcttaaaaatgaggtaagcaacgattgcactggcaatggcatcggcgtacaacagataggaccatccgcgggtgtttccgatgatagccaacaggacgccgataaaagcggcaagagaggcaacgatatcgcctttatgatcgtacgcaatcgctataatcgctttgctgttccatttttccccttgctttatagaataacgatataagatttccttagccacgtacgaaatcagagccgcaaacaatgcgctgtattggggaacgcttggccctttaacaaaggacagaatcgcttctatgaggatataaacggatacgatcactaagataattcctacaatcgcctcactaatgacttcagcttttccgtgaccaaaaggatggtcttgatcgggcggtttattggaaattccgatcactgccaagactgcaatcgaagcaacgacatctgccgcggaatgtattccgtctgcaaacacggcttcactatcgcctaccagcccaaaaaagacctttcctgccattaagatcagattggcgatcaatgcaatcaaagcaacttttctgcttatttgttctctttcacttgccattttttcctcctataaaactgcacaaaaaaataggagtgctctatatacgctctccgtatcctttcctgtgtaatcactttgtttatcataccaattcaatttcgagtgggtctatagcaacgttgtttcctgtttactaataaataaggtgacagaaaaaaagttggagctgtgctaaaagggtcatacagcaaacaaatgagttcttatgtaacaacagtgatgattcgccattaaaatgctgccgtcagtgaaaaatttccacctgattgttaaaaacctattgacatgagaagatctgtattttattattatctcatattcaagatattttaattcgagatatttgattgaaaagatcagcgatcaagcgcaactctaagtgttcaatcgttgtcagttcttttacacaatattcaatatgattttttataacataatatctcgaattcgagataaaagggagtgtatcgtaatggctgaatttacacatttagtcaatgaaagacgatctgcaaacaattttctttcaggtcatccaatcacaaaagaagatctcaatgagatgtttgaattggttgcattggcaccatcggcttttaatttgcagcatacaaaatatgtgacggttcttgaccaggacgtaaaggaaaagctgaagcaggccgcaaatggacaatataaagtgattagctcttctgcggttctcttagtattaggggataagcaggcatatcaacaagcggccgatatctatgaagggttaaaggtattggggatattaaataagcaagagtatgaccacatggtgcaagacaccgtttcgttttatgaaaacacgggagaacaatttaagagagatgaggcgataaggaatgcttcactttctgcgatgatgtttatgctgagtgctaaggaaaaaggctgggatacctgcccgatgatcggctttgatgcggaagccgtaaaacggattttgaacatagacgaccaatttgaggttgtcatgatgattacgattggaaaagaaaaaacagagagcagaagaccgcgcggctaccggaagcctgtgaatgagtttgttgagtatatgtaaaaggagcggataaaaatggctaaaaaaacgatgggaattcatcatattacggcgattgtcggtcaccctcaagagaacacagatttctacgcaggagtgcttgggcttcgtttggtcaagcaaactgtcaattttgatgacccaggtacgtatcatctttattttgggaatgaaggcgggaagccgggaacaatcattaccttctttccgtgggccggagcccgccaaggcgtcattggagacggtcaagttggcgtgacctcgtatgtcgtgccgaaaggggctatggcattttgggaaaagagactagaaaagttcaacgttccatacaccaaaatcgagcgctttggggaacaatatgtagaatttgatgatcctcatggactgcacttagaaatcgtggaaagagaagaaggagaggctaacacgtggactttcggagatgtaacgccctatgttgccattaaaggttttgggggtgcaaccctattatcagcgcagcctgacaaaaccgctgaccttttagaaaacatcatggggctggaacgagtcggcaaagaaggagacttcgttcgttatcgttccgccggtgatatcggaaatgtgattgaccttaagttaacgcctattggccgcgggcaaatgggggcgggaacggtgcatcacatcgcttggcgggctaacgatgatgaagatcagttagattggcaaagatatattgcttcccacggatatggtgtaactcctgttcgggatagaaactactttaatgccatttacttcagggaacatggggaaatcctgtttgaaatcgcaactgatcctccaggctttgcacatgatgaaacacaggatacaatgggcgaaaaactgatgctgcctgtacaatatgaaccgcatcgcacacaaattgaacaagggctgctgccgtttgaagtaagagagttagattgatttgacacataaaaaataaagaaacatatattcaattgatgattgctggatggtactgtcagcaaagaatcagatgaaatcaaagatgaggagagatacaaatggaagatgcaggactgttgcttattcgtataatgattggtgtagtgtttttgttttatggcacacaaaaattattcggctggtttggcggatacgggattaaaggaaccggacaatggttcgaatcaattggggtgaaaccaggaaacgttgcggccgctctatcaggtcttggggagttagtaagcggaattctatttattttaggcgtattcctcccgcttggagctgctatcataacgatcatcatgttaggtgctattgtaaaagtccatggagcgaaaggttttgcgaatggcgccggaggttttgaatataacctggtgctcattgcagtttccataggggttgcactcatcggttcaggagcttacgctttgcatttttaatacgaaagtatgtaagaacagttgctgcttgtcagtaactgttcttttattttgacattttcggcaagcttgcaggtactctgcaaagtaaaaaagcggatataataaatataaatcagtatagtgaatgatacgtattgatgagcttggttataaaagacagacctatttgaaggagtaaatggatgaaagagatgacagaattacattcattagattctatagataattttatcaaacagcacaaattcagttttatttatatatcaagacctgcctgtacagtatgtcacgcagtcctgccccagctcagaatagtattggatcagtttccaaacatcaaattggggcatatcaatgctgacgatgtagcagaggtcgccggcagattttcagttttcaccgttcctgtgcttcttttgttcattgatgggactgagtttctaagagaagcccgttttgttcattttgaacagcttgaacaaaagctgaaaagggtttatcgattatatgaaggcgaataaagaaataaggcaaaaaaaagaactcaaatgagttctttttttgcatcaatttattcttcactaggcgaagaagggttatcaacctgcccttgatcacttgtatcattatcacaacttgctgaaataataattgaattagaaggagagtaatctcctaatgtgaaattgacaccgtaatttttgctgttcgcagtatggctgttttgcaagttttgtccgatatctgtattggcgttttgtgtcattccatttatcgtgagatttgaaatgttgatttgagatcgcatgcttcaaaaactcctttcactcagaagtagctgtcataaaggacactggcagtctatttacttctatgatattgcgtttttatatctttgcatcaacataatggtaaaaataatagcgagtgaatgagtctcttttgaaggtgatcaacctatcagcagaaataaagccgcctgataaagaggcggcagatcgttatatgtcatctatgaatttgatgtatcgtttttcgtttgcctaaaggataagatggtcgtttttaatgatgagtaggagcctatagcagcgtagccataaaaccagcccataaatacgccagaaaagaggctgtgtcgatggcttatgaaaacagaaatgacaaggcctgttattaaggcaactgacggtacaaaagttttggggattttcaataatattttgaggatttgggttatcaatatgatgattggaacagctatcacagcatcccaaaagttcgtgtgaataattggaaaagccatacggcacctcatgaagtgttaatttcttatttttacgctaaaagcttggaaagcagtccttggaccgcatttgtaacatgtagggcttgattggcggagcttgtttggcttaaagcattggattcaaaaaccaaacctgtattattccctccggaaccatctgtctctttagaaacagagaaagggctgatggaaaatgcaaaaccgttattaaaaacgctgtttccggatatcgaatgaatataaactgggaatttcatcattcatctctcctctctgttatgactgtttatacaatatggtgtgtgagcagcaattgcttaaacaaaacggcaaaaacattcagtgagagacaaaaacctgcaaaattctccaagtgccttttgttaatgcagttttttagggatgttttttttattctttttgtcaatttcatcaaaaatattctgattgctagacaaatgggcttgtccgtccttattaatgaaattcgggtgaatgagtttttttagatccctgacagttaaaggtttggcgtcatcagttaattctattcctaattgcccgtttgcttctaatgtcgcaattttgacatcttgtatagccgtaacgccgtgaagccgtagctgcatttcaagctgatcagctgtaagtctcatcttcttcaggttttcgatatgaagctgaccgttttcaataacaatttttgcttttccggttaacatcttttcaatgaagttcgatctcatttggatccattccataacgatgagtgtgattgtgaaaattgccgccgcaattaatgttttgaagaggctgtactcgatgattggctgaacgataatagttccgatcgaaatcatgacaaccgtttgagttgaagtcatttgtgcgattgattttcttcctgaaattctcagcaagatgactccggctacaatgagaacaagagattcccaagtgaaattcatgctaccacctgaccaatgatgaattagatttgtcatgggattggctttccttccggccaatcgcaatttaatatatccgaaaggcagtcggttcattctgtcctgaaccgaacaatatttttggtatagatggatatattaagccaaacaatgatagcagcaggagttttttggccgaaacaatctgggaagcggggagcgccataacatgattgaacttgaagttgtcattagaacggttgccagctttggcttgctgttaatcgcagaacgaattttaggcaaacagacaatctctcaaatgacgatttttgattttattgcggcgatcacactaggggcgattgctggtggattagcttacaatacttcaataaaaccgcacaatatggccatttcgtttagtatttttgtgttaaccatttttctaatttcgtttctgtcgataaagaacaggaagctgaggaaattttttgccggagatccaacagtgctgattcaaaacgggaagatacttgaatcaaatatgaggaaaatgcgttacacacttgattatttaaatcagcaattgcgggaaaaagaaatatttaatatcgaagaagttctttttgccattcttgaaacgaatggtcagctgactgtgttaagaaaaccgcaattccggcatgtgaccaaacaggatttaatgattgcggtaaaccaagaacacaggcttccgatagagcttattatggacggagaaatcattgagaataatttaaagcagaatcgtttgacggaatcctggcttttggaggaattgcgaaaaagagacataaaggtgaaagagaccgtgtacgcagtgctgctgggtaatggggatatttatgtggatcagtataaagaccatatatcagtccctatggataaggaatgaaggaacaatcaatcttaaagccccttattgaacgcaatggtttcaatttgtcttgggtacgaaatgtgcagaagcccgtttaacagctgaatctgtaacaaatgagattcagtggcttcgggaagctgaatgattcgctcaatttctccgtaataccgttcacgcagcacttccatttcggcaggaaaaacaggcgtgatcgttcctttgatcagcagctgggttttagatagtaaacggatcgttaattcttcctcatatacaccgggcatttccacaatgataaaattatattcttcatcttgataaaagtcgtaaacaaatgtagaagcttcggaatcaaaaaaatgttccggggctttatatttgagcacatttgtccaaaagtcactttgtttatattcattcgtaatctcaagccactttcgaattttttcgaaatccatatgagattctccttaaatttgatttgcaataggcgcagaagggtttccgatttggtcttggtcactaacgtctgaatcaatatttccagtgttcaaaagtgaagacgtaggcgaaagatcccctaaggaaaagtttgctccaaaatatttgctgttcgcagtatggctgttgtgcacagtcgggccgacatctatatttccgttttgcgtgacgccgttgatcttaatatttgcgatgttaatttgatatggcatagacgaaacccctttaatctaaaattggcggtggtgcaatcggaggagcattaacgttggatgtatcagagttgccgatagatgtctgatcatttacatcaggatcgtttaagaagttttccataaccgattctgtaggtgaggtatcaccgaaagaagaattggtcccttgagatttttgattgttggtagggctgttataagcagcttcgcctattgtaattgaaccattgcccgaaatactgttgatcttcaaataatataggttgattactgtagacggcatcccatcacacccttccatctttctgtacagtacattatgcgccgctgcacccaattgttccttgcatttgcgggcaaaactctatctggccccggagtgatgtttgttagaaaaaaagaataaagtttatcacagcctgaatgtcaatctattcagaaaatacttatcagtgaatgaaaagccattgatataataaattgattcagttattcgaaatacataagaccctttaataaaggaagctggcaacaggatgagtttgaaatcattgacaatgaagctaatgccatgaaataatactcgtaagtaacattactcgtgagtattattttgggggtggtcctagttgaaaagtaaaggacgtaaaggagaagaaagccggaaacggttactcaaagttgccgctaatgaattttcggttcggggattccatgacgcgaaggtaagtgaaattgtgaaaaaagctgggttcacgcagccttcattttatctgtactttcaaagcaaagaagccatctttgccgagttaataaccgattttcactctcgagtcagaaagctgacagagtcacttcttctggaaaacggattaaacacggaggatgtgtcaaaacgggtactgctagctgtagagactgtttttcaatttttggctgaggacaaggatttaaccaagatcggcttttttctcaacccggaagcaaaacaaatgaaaaaagacttggcgatggttttgaaagagaacttagaagcagaacagcggcttggctattttcactctgaactggatatggaaactgtcgctgagtgtttggtcggcatgattgaacatttaaccgattcatttttgttaaccggaatcaaagatccggcaagcctcgcagcagaggttgtgaatcttttaatatacgggatgcttccgaaagggaatgacgtaagatgatatctattattacgaaagtcagtttggcagtttttatgcttgcgggaggcatcataaaggtaagccgcgttccctttcaagttgagcattggcggcattatcaatatccattatggtttctgactgttactggcattcttgaaatagccggggcacttgctatgacagcgggaatttggaatcggtatgcagcaattggagcaggtgttctgtttgtcgttctcatggcgggagcaattcatgcgcatatgtttcgagcaagacaatcggtcatcatggcgataccagcgatgatttgtttgattgtttctatcatgatcatcctggggagttacacgtaagcttttcactaatgtttaagaacaagcccatttgcaggaaatctccttttcttatcgaataatagaaagtccaggaattaactgaatcagtaaaatagagctccatttctgcgttattcgtccggcatcagctgggctttttttataaaggaggaatacaggatggcattaactttggaagacatgactgaggaagagttcgaagcctttcgagggatgtccgtgcaaaattatgcgaaacaaaacataacgtcaggaacttggacggaaaaagaggcgcttgagaaatcagagcaggcatatgagaacatgattccgaatgggcgagacagcagcaatcattatttttggaacatcaccactgaacaaggggaaaggatgggctggctttggctgtacgccgatccgctccatccgcaaaaggaagcgtttatctattcctttggattgtatgaagcctttcgcggaaaaggacttgctcaattggcgcttcaaacgcttgatgaaagagcaagagagcttggtgtggaaaggctggctcttcatgtatttgcacacaacgagacagccgtctatctctatcagaagatgggttatgccatgaccaatatacgtatgcggaaacagctatagtgaaaagccgcttacgttacccaaatacaacatgcctatctggaagcggtggcaggatactataagtcatcattagaaacattaatgtcatgagaaggcttgaacatataaagaaaaaggacaacagctgttgtccttttcaatgccgcttgaactttctccctcagtcttttttgtcttgatgatccagctcttttattcgtttcgtaagctcattgaaagcctgatcaagctccttataccctttatcatttggcgtcataaaactgagttttcccagcacttcttgtctttctgtctcaagctttaatcgaagctcttcccgctcatttctttcagaaggagcggcgtcatttaactgcttttcgatgccgttgtttgagatgacgagtttactgtttgttgttttttcgagaaagtatcggtcatgtgaaaccgccagcaatgtgccgctgtattgtgacagtgtttcttccagctgttcgcgtgaaggcaggtcgagatggtttgtcggctcatctaaaatcagcacgtctttttcctccagaatatatgccatcagcttgatctttacacgctcacccatactcatatgcttgatcggttcagtccattgggcagctgtaaaacctaagtgtctcatcagattttgaacgtgccctcttgctttaaatgtttcattctcaaataactcttccggtgtttgttctaaaggcaaatcaaacacctcctgcgttaaatagccgatgtttgcagacggcgacacccatacacttccttctgctgtttcctgtcccagaatgatgttcagtaatgtcgtttttccgctgccattggggcctatgatcgcaaccttttcgccgtgctgaatcgtaaagtttgcgtttttaaagagggtcctttctccaaacgcttttgttacattctgaacttctaaaaaacgttttcctgttttgtgggttgtatcgattgaaaagcggactgtatattctggggttacgggttccgcctttgctttttccagctctttttcaagccgcttctgcttggatttaatctgggcatccgtacgcttcgcttttaccctgtgatattctttaaacccttcctttttcgtcgattgggcgtgggctttttccgaccaagaagcgagcccattcatttgtgcttcaatccgttcaaccattttttgctgcttttcatattcacgctgctgggtgagtcttttcttctcccggaacttcatatacccggagtaattccctttgaattcaatcagcgtctggtcctcaagcgaccatatttttgttgcggcttcgtctaaaaaatatcgatcgtgagaaacgagaatcacagtgccgctataatgtttcagctgttggatgagaaattgcaagcttttttcatcaaggtggtttgtcggttcatctaacagcagcagatctgcatcctctgatagtcctttcgccagccgcgctttcagtttttcaccgccgcttaactgatgaaaatcacgaagaggcacatgccatttctccagtaacttcttttcggcaggtgtctgatccgcaaaggaatacgccgcggtttcctgttcaaccaaagccagttttatatccttccgaaggatttgaccctgtgcaggggctaagtcattgtgaatgaggtgcagcagcgtagatttcccagcgccgttttttccgataatcccaatgatatctccttgctgaacactggcgtttacatgtttaaaaacagttagatcctttacttcatagctaacgtttgttaatgttacgatctctttcatccatatccctcgctttaaagggagaataaaaaaatcctcccaaatgtgttggaaggattagctgcgcctgtgcatgatcaaataagctattttttataaatagccggtgtcgtatatatagaaaatgggcagactaatcctattttttgatttgaaatattgatttcaaacggtaaaaataagattagttaatcattgtccacccatcatcccttcttgttttgattacaaacactatagcataccttcaaattcaaaagcaaaggtcatttttatcaaaaaaactcctgctctcatttttgaggcaggagtttcgagtgttattgatgcttcgcttttctcactttataaatcacaatcagcaaaataaaccaaaccggtgtgacaaataaggaaacacgagtatcctgtgccagtgccagcacaaccagaacaaacgccaggaacgcaagaatcaggtaatttgtaaacggataaagcggaagcttaaacttgtttgttttcgctaattcaggtcttgttttgcggtatttcatatggcagatgaccgtaattccccaaatgtagataaagcatacggttgaaatacttgtgatcagggtgaatacgccttctggcatgatgtagtttaacgtaacaccgattaaaatcacgatagctgaaaagaataaagcatttctaggcactttacgctgagtcagtttcgccattgactcaggcgcattgtgatctttcgccagggaatagaccatacggcttgtactgaatacagcgctgttgcacgctgaagcagcggatgtcaacacaacaaagttgataatacttgcagccccgacgatgccaacagcgacaaatacttgtacgaatgggctttcgctgggattgatgacatcccaaggatagatgctcataatcacgagaagagccccgatataaaaaagcagcacacggacaggaatattgttgatcgccttagggattactttttcagggttttctgtttcaccggccgtaagcccgacaagctcaatgccgacaaaagcaaacacaaccatctggaacgagaggataaacccgtgcatgccattcgggaacaggcctccgtgactccagaggtttgtgaagctggacactcctgagcttgtggaaaagcctttgaaaatcatcacaaggcctatgacgattaacgccaaaatggcaatgactttaatcaaagcaaaccaaaattctaattctccaaaaagcttgactgtcgccagattcataatcagtaaaataataagagcgattaagccaggcacccattgcggcacacctgggagccaatattgagtgtagagcccgactgctgtcagatcagccatcgcaatggaaatccagcagaaccaatatgtccagccggtgataaatgctgccatatcgcctaggtagtcttgtacaaaatccacaaaagagtgatagttcaagtttgataacagcagttcacccagcgatctcataattaagaagcaaatgatccctgtgatcatataagcaaataaaatcgaaggtccggcaaaatgaatcgatttgcccgagccgagaaataagcctgtcccaatggctccgccgatggcgatgagctggatatgcctgtttttcaagcctctctgcaacgtttgctgatttatattgtctttcgtcatgtcgtctgtcactttatgtgttcctccattgaaaattgtttattgagtcagcaatctatttttaatgattattataacactaaaatttctatcttttttactaaaaaaggattgatgaaaagaattttaatgtgatttggactatttcccgaaaaaagcggctccatttagggagccgctttcttatgctttttcagttttttcataaacaggtagagcccgtaatctgtcggtgcggatgcgtagcctgcctgccgcagcattgctgtgatattgccgcggtggtatgtcccgtgattgacaacgtggggaagtagttcggaaacagttgatttcatgattccgcttgagggattttgaatctggagtggcttattgagctgttctttttgctgtaaaaatagtgtaaagcgctcggataacctcagaaaaaggtcttccatttcctctatttcttttgcctctgtctgttctttaagctgttcagctaaagccaacgcatcgctcaaggttttgccggaaaacacttcaatccagccgagatcagaaagataaacatgagacaatacatgggatattgacggaaacacgctttgaatttcttgatggtatacctcttttggaagctcttttaatcggttgaatatttgttgattggcccagacgttatattcatacaatttgaacgccaaatctgacatgttaaaattccccctttcatgtgtatagcttctattatacacgaacgtgcgttctcgtgtagagtgcccgtgaataaaatttgttgacatatatagtttagaggaataaactaattgacattgaacataaagtttagcggggtaaactataatgaggaggggaagatattgaatgaacaaaagctatgtcaggcgataaacctgtttgtggaagtcctgcttgaagggacagaatttgtgcatcgtgaaatcaatcaggatgtcttcaagcatatctcaagggaacaggcagacctgttgaaaattttaaaagtcaagggcccaacctctcccggcagcctggccatgtaccaaaatgtacataagagcgcgatctctaacagactgaaaaagctgctcgaaaagggattggttcaatgggacgacggtccggaaaaaagtgataggcgctctaagcttattaacattacacccagtggtgaacacatactagaagaattagattctgccatctttaacgcgctcaaaccgttgattgatgatatagatgaggaacacttacattccatcatcgagatattcaccattttaaaaagcaaatttaaaggaggagattctgccgaatgagagcaatcatcaaattcaagtgggcaattgcagctatagtattagcacttaccgtcgttttgagtttgttttctccgaacttaacggagctggccaatcaaaaggggcaggcccagcttcccgctgatgctgtttcagaaagggcaaacgccattttaaaacaagcgggagaagacaataattcgatcagtgttgtctttacattagacaacgctataaagaaagaaacagagaatcagctccggataatgattgataaaatcaaaaagatcgacggtgtagaagaggtaacatctcctctgtcagcggaaaaagaagtcaaagaccagttgatgtcgaaagacaagaaaaccgttctcatgcctatcacgattacaggttctgataaaaaggcggaaaaaattgcggacgagatttatcaaatcgttcctgatgacttgacggcatatattacgggagcttcccttatcaaccaggatttcgctcacagctcagaggaagggcttaagaaaacggaagtgatcacagtctgcctgatcatcggtttactgttgatcgtgttccgatctgttgtgacgccttttatcccgattgtggttgtcggtttttcttatctgatcagtcaatccatactgggcatccttgtatacaatgttgattttcctatctcgacgtttacgcaaaccttcttagtcgcgatcttgttcggcattggaacagattactgcatactgcttcttacacgattccgtgaagaattggcaaacgggcatgataaaaaagaagcggcgcttatcgcttaccgcacagggggaaaaaccttatttatcagcggatttgcggtattgatcggattttccgccttaggatttgcgaagtttgcgattttccaatccgcagtaggggtagcagtcggtgtgggaattttaatgatcatcctctacacactgctgccattatttatggtgacgctgggagaaaaattattctggccttctaagaaagtgctgtcacacagtgataacaaactatgggcgtttctcggcagacactccgttgcgcgtccgtttctgttcattgtcatcacggtggtgattacgcttccgttcatcttgacctatgatgaccagatttcattcgactcaactgcggaaatcagcagcgattataaatctataaaagctctcgaggccattaaggatggattcggggaaggaaaagcgttcccgatcaatgttgtcgtaaaaggagacaaagatcttacaacagctgatacaatcccctatctaggaaatatcagcaaagcgatcgagaaagttaatcatgttgactctgttatgaccattacgcagccgactggtaaaaaaatcaaagatttatatattgataaccagctaggatcggtttcagacgggctggataagacggtgaaagggattgccgatgtccaaagcggattaacggatatagaaaacggactgaatcaaatggcagggcaaaccggctcggcctcaaatggagggtctggcggttcactgggcgatgcggcagatggcttgggcaaaatcaatcagcagctgcagctcgtgagcaaacagatttcccaaaccggcaataccgcacagaccgtgcagcagcttacggcaataagcggacagcttggccagattcaaaccggccttgaacaagcgaaccaacagctctcaggccagcaggcacaagccggaacgctgacagaaagcctaaaaaagctgtccgaaggcgtgaaaagcgcaaatgagggcctgacgaaagtctctgacggtattacagcttccagtgatatattagaggacatgagcaaaagtccaactgtaagagatactggcatattcattcctgatcaagtaatgaaggacaaagactttaagaagtcaattgaccagtattcctttgcagacggcaaaggtgttcaattaagtgtcgttctggattcaaatccgtactcagaacaagctattacgacaataaaccaaatcaaaaaagctgtcgcaaacgaagttgacggcactcctttggaggatgcacagatcgtatacggcggggtcacgagtatgaatgcggacttaaaggagctgtccacaacggacttctccagaacaatggtgattatgattataggcctgtttatcgtgttaaccattttgttccgctcaatgatcatgccgatttatatgatcgcgtcattgctgctgacgtactatacgtcgatatccataacagaattaatttttgtaaacggcttaggaaacgcgggtgtcagctgggcagtgccattcttcagctttgtcatcttgatcgcgttaggggtagattattcgatcttcttgctggatcgatttaaggaagaggtgcaccttggcattgagcaaggtgtcgtcaggtcaatgagcaaaatgggatctgtcattattacagctgccattatattggccggtacgttcgcggcgatgatgccttcaggtgtcaatacactgatgcaggtggcaagtgttatcatcatcgggctcttgctttacggccttgtcattcttccgctcttcatcccggcaatcattgcgacctttggagaaggaaactggtggccgttcggcaggaagaaaggaaaagaataatcgagagaagagtgatgaatggtcatcactcttttttcatgactaaacgactaacttcagacgtgttaccaaaaaagatcagacgatcaaacggcggctgtacttaaaaacaaagagcccggaaaacattcccgggctctttgttttatttccattctgcaattgtatcaatcggcagacggtaggaagcatagccttcgtctgctgcttttccgatagaaagtagcataaccggtacataacgttctttatctaatccgaaggtttccgcgatgttttctttatcgtatccgccgatcgggtttgtatcgtagccatgcgcgcgtgcagtcagcatcagctgcatggaaacgagacctccgtcaatcaggatcgtttcacggttgacctgtgccggaagcttttcaaaatgtgcggtcagcgcggcgatttgtctgtctttgacctcctgcggcatgtaaccaagttccacggcttttgaatagatttcttctaggtagtctgcattgttcatgtctgcaaatacagcgatgacagcagatgatgttgtgacctgtgtttggttaaagcttgcaagcggtgcgagcttttcttttccttccgggctgtcaatgacaagaaaacgccatggctgcgcgttaacagaagatggggcagttgttgcttcctctaagatctctgtcatttcttctttgctgatttttactgccggatcatagttgcggatagaacggcggcctttcataatttccataaaatcgtttgttttgatcatgttgatacactcctcttaagcttcgatattatttatattgtttcgcatgcgcgccagcacatcaatgagcaggcggcgttcttctgcgcttacatttgcgagcatttccttcatgaaacgctccttttccttcttagaagactcaattcgctctcttccttggtctgttaaccgaacaagggtgatgcggttgtcctcaggcttgcgccgccttgataccatgcctttagcttccagctgtttcaggtgtctggtaacggctgcgctatcgatatttactttcttttgaaggtcgctttgactgatctcatctgcatgataaagcaatgtcagcaattccaaacgagattggctgatgcccgtgcatgcctcgaacttcacgccaatcaccttgttcacgccttgcagctgatataaaatctcggcttcctctgaacaaaatgacgccaaaacccatcccttctttcctgtcaaaactattaattgatatatcaatgattgacacgtcaattaatatacaacgattgatttcatcttgcaagccatttgcacttttgaacaacctcccagcgcataaaattcgctaggctagaacttagcaaaaaaagctggccgtttcttcagatgatgctgatcacgatgattccccgcatcattccctttataggtgttctgaatatcactttgcctagcccgtgctcaagcggctttcacaggctgaaagttatgatacaatatacaaatgtttcacagcttcaatccatagttggagctgacatccattatataagggactaggttgaagggaaggtttgataacatgctgcacaatccaactggaaaagaacgcttggcactagcgtttctgctcggcatgcttgctatattgggcccgcttaatatagatatgtatttgccaagttttcctgaaatcgcggaagatttatcagcaagtgcttcacttgttcagttaagtttaacagcctgtctggtcggacttacgatcggccagctgattgtcgggccggtcagcgatgcgcagggaagacgaaaaccgctattaatctgtatttttttatttgcgttatcttctctgttttgtgcactgtcacccaatataacaactttagtggctgcgcgttttttacagggcttcactgcttctgcagggcttgtgctgtctcgcgcaatcgtccgcgatgtgtttaccggaagagagctttctaaatttttctcgctgttaatggtcattaccgcggtggcgccaatggttgcgcctatgacaggcggtgccattttgcttttgccgttcgcaacgtggcatacaatttttcacgtcttaatgatcatcggatttttactagttcttctgattgcattgaggttaaaagaaacgcttccgccggaaaaacggattccaagctcaatcggaacatccgtcaaaacgatgggcagcctgctgaaggatcgatcctttatggggtacgcgttaactgtcggatttattcacggggaagctttgcatatgtgtctggtacgccttttgtataccaggatatctacggggtgtctccgcaggtatttagtattctttttggcattaacgggctggcgattatatcgggcagctttatcatcggacgctttggcggaatcattcatgaaaaaagcctgcttcgtatagcggtcattacggctatgattgcgacggctgtgctattaaccatgaccatgattcacggtcctcttgctacattagtcatatccattttcatttacatgattacgatcggcatggttctgaccagcacgtttaccctagccatggaaaagcaggggcaccgcgccggaagtgcaagtgcgctgcttgggatgctcccgctgctccttggttcaatcgtgtcaccgcttgtaggcattaatgagacaacagccgttccgatgggagccatcatgtttgtaacagctgtcatcggctcactggcgttttttggattaacgaaagaacgagtagggcagaattcataaaaaaacctgacatgacgtcaggttttttgttttatttagaataacaacagcaggcctgcaatcgccggagtcaaaaagatggctgatttcaaaaccacctttggcatgaggttggtgaatttcgcgcctacataggcaccgcacattgtcccgaccagaactttgacaagcaaaacgtaatcaacaaaaccttctgtgatatacccgatgcctccacctacagccagagggatgatcacaagcatcgtcgttccgacagaatggcgaatggacagattcagcataatcattaaaccaatttgaataaaaggtgccgacccaatgccgaatgtgccggaaagaacgccggctgcaattcctaagatgaccgctctcgtatacgttgaaagagtgctttgattcacttgagccttctcttttaaaataaataatctgattaaaatgagaattgctgataaaaataacattccagccgtcaaataatgaagcaaatcagccggaataaaagatgtcagcttggcgccgaaaaatgagccaaccgcagcaaagcctccgactattaagccgattttcatttgaatgtttccctcgcgatagtggctgtatgcccctgataagcttgtaaaagccatgccggcaagcgaagtgcctaaagccgtatgaatcgggatatggaaaagaagcgttaaaagggcaatgacaaagccggctccaccggcgccaataaagcctaaaataattcctagaagaaacataacaagaataatgagcatattttttcctccattgaaaagatgtaaaaatgtaatcgtgcgctattctggcggaggtatgatgtcctattgacgaagaaaaacacgccgttttttcagttgccagtagtccgtcgaccgtcgttcagcaaacatatcgtacctcaaattcagggatctgacaaggcagtttgttgcttcccattaccatctgttatatgattttgatgaagaaaagcccttgaatatattcaaaagaggtattatatatggacgattttaaattagataagccgactccctactacctgcaattttataaccagctaaaaaaaatgatcttcaacgggacttttaagcctggggaacggataaacgaaacacagctggcgaaaagctttggcgtcagccgctctccgataagggaagccatgcgattgcttgagaaagatggtttgttaaaagcggatgaccgaaatggattttcgatcacgtcattaacggcaaaagatgtagatgagatttataaaatcagaattccgctggagcagctggcagtcgaattagtcatagacgaagcggacgaagaagagctgaccatactcgaaaaacagcttgaagaaacagagaaagcgattcacaacggcacggaagatacggaaatcattcgtttaaaccaaaaatttcatgggctgctggttgatttcagccataacagacatttgaaaaatttgcttgagcatataaatgatctgattcatttttgcagaatccttaattataccggcgaccaccgtgcagaaacgatactgcgtgagcaccgcaggatatttgaagaagtgaaaaagaaaaacaaagaagcagccaaacagcatgtgctggctcatttcaatcatgactgtgagcatttgaagcatgtgcttgaagaaggaaaagagaattgatttgtatgatccggtaccaagggggagcagaacccttggtatttttttatgtattcaccacatatctaagaggccccgttaataagattttatgatggattgactaacgaataatgggggttaaacatgtttatccatatcgtcgggcctggtgattctttgttttccataggcagaagatacggtgcttctgttgatcaaatacggggtgtgaatggtttagaagagacaaatatcgtgccggggcaggctctgcttatccctctttatgtatatacggttcagccgggagacacgctgaccgccattgcgacaaaagcatttgttcccttagagcggctgcgggccgcaaacccgggcatcagcccaaatgctttacaagcgggagcaaaaataacgattccttcgatctcaaattacattgcgggaacgttaagtttttatgtgcttcgtaacccagacctcgatcgggaattaatcaatgattatgcgccatactcgtcttcgatttcgattttcgaataccatattgcaccgaacggcgacattgcaaaccaattgaatgatgcggccgctattgagacaacttggcaaaggcgagtcacgccgctggcaacaataacgaaccttacatcaggaggcttcagtacggagattgttcaccaagtactgaacaatccaacagcgagaaccaatctggtcaacaacatttataacttagtttccacaaggggatatgggggtgtcacaatcgattttgagcaggtgagcgccgcggatcgcgatcttttcactgggtttttacgccagctgagagatcgacttcaggcgggagggtatgtgctgacgatagccgttcctgcaaaaacaagcgataatattccctggctgagaggctacgattacggggggataggagcggttgtcaattatatgtttatcatggcttatgattggcatcatgccggaagtgagccgggtcctgtagcgccgattactgaaataaggagaaccattgagtttacgattgcgcaggtgccgagcagaaaaatcattatcggagtcccgctctacgggtacgactggatcatcccgtaccagccgggcacagttgcttcagcgatttcaaatcaaaacgcaatcgaaagagcgatgaggtaccaagccccgatacaatattcagccgaatatcaatcaccgtttttccggtacagtgatcagcaggggcggacgcatgaggtatggtttgaggatgtcaggagcatgagccggaagatgcagatcgtccgcgaatacagattgcaggctattggcgcttggcagttaacgctgggctttacaccgggcccatggcttctgcggaaattttttacgattagaaaagtgtaaaaaaagacaccagagcttgggtgtcttttttttgattaagtccagagcagcagaatagttcattcatttgtaccttgcatgggttgtgttcccattttacgattagtagtagtctgattaaacaaagagtcagaatacgatttgagagggagttgtctacatgaagacagtattgattttgaattttcctgcggaaggccatgtgaatcctaccttaggcattacaaaagcgttttccgataagggatatgatgtccattatatatccactgaaaaatataaagaacgattagaagcagcgggagcaacggtccatcttcaccgggatctgctgcgaacgacacctattcatgtcggttcgcccaatggcattcttgatttcgtgaaaatccatatcaaaacgtcattggacattttacagattgtcaaagacttatctaagagcattcaatttgattttgtttattatgataaattcggcgcgggggaattggtaagggattacttagatattccaggagtctcttcatcggcgtctttcttgtttggcgaggagcacctgaaaatcctgccgctgcatccggagtctggagcgccgcttgaattggatcaagagtgcgaagaccttttggcaaaaatgaaagaaacgtacggtgttgccccgaaaaacctggttcaattcatgaacaataaaggggaattgaacgtagtgtatacaagccgttattttcagccagaaagtgatcgtttcggggatgaatgtctatttatcgggccgagctttccaaagagagcggaaaaaacagatttcccgattgaacagctaaaagatgagaaggtcatttatatttcaatggggactgtactggatcatacagaggattttttcaacctttgtattgatgcattttcaggctttaacggaaaagtcgtcatcgctgccggagaaaaagcggacctgaccaaattaaagcaggcgccggaaaactttatcattgctccgtatgtccctcagctggaagtgctggagcaatcggatgttttcattacacacggcggaatgaacagcgtaaacgaaggcattcatttcagcgtgccactggttgtcatgcctcatgacaaggatcagccgatggtggcgcagcgtctctctgaactccatgcaggctatgtcatctctaaagatgaagtcaatgcccaaatattaaaacaagccgtagatgaggttttgcgcaacgatcagtatatggcaggcattaaaaaaatcaatcaaagcttcaaagaatgtatggacatggaagaagtgatggagcggattgatgagttgattcgccaaaaaaacaaataagaaaaagaactcccgtaccttgtacgggagttcttaatttaaaacttaattttgattttttgagcatcactgattttcttatggttatggtcaaagacgtcacttgtcgtgatttcgatccacttgatctcttttgttttcttctcagcatccgcggccttatcatgagcatggccgcttgatgcgttcacaataaagccgagatttccggacttttcggcgccaccttccaattcgccgtttaactcttcaagataaatatctttgttccaatcaaaggtttcgcccgtatttgttttcatcaatgcaatcggcgcaacatttactttttttgaagaggtgttcttgatatcaacgaagaccttaacgaaatcaaactcttcatcgtgtgttaactcatgaaagtaatcaatcatgctgtagtccgggcgcaagtggatcagcttcatttcttttaccgttaactccacgtcgccaatcttataggttttgttcacttgtttgatatcttttaagacagcttttcctttatcatctgaaaacgtttggccgaccttaagcaatgaccggtcatcagttacctgggaattaggctgataatcatctgtgctgtccttctgggatgaagtgctttgcggctcagcttttactgttttctccccgcctgcatgctgtttttcagtactggcgtttgatgagcagcccgcaagcatgatagcaaaaacgaaaattgaaagaattcttctcatgatgattcctccattaaaaagagatcccgttacttcatacaagcaacgggacaccttgtattcttttacttatcgttaatcttaatgttgtattgtaaagccttgaagacattttttgcgatttctgtattatcaatttggccggcaaatgtctcactagacggaccgtatgcatagacgggaacatcttcaccggtatgtccgcctgttgtccatccagtgtgagagcgtttattaaagatgttctcgattgcgttatcgatatccagtacttccttcgattttgccgcttcttcaacagattgaatttcggcttttgttaaagccaattttttttgatcgatatatgttttcaacgttttttcaacatccgcgccgtcagcgatcttttctgccataaagtctggtgtgcgctttgcggctttaatgggttcactgaaccagttgtagatgccgtccgcaccgatggaatatccgccggttgaatggtcagccgttgcgacaaccaatgtgtgcttgtcttttttagcgaaatcaatagccgccttataagcttgttcaaagtcttccatctcgctcatggcgccgacgatatcattgtcatggcccgcccagtcaatttggctgccttccaccatgaggaagaatccgtctttatccttgtttaattttttaatggctgtgtttgtcatatctttaagtgatggaatatccttcgtccggtcaatctttttaggcaggccgccgtcagcgaataggccgagaacttggctgtctttgtttttcagcatgtccttgcggttatccacgtagctgtatcccgcttttttgaattccttgatcaaattacggtccttacggtcaaaattgctctttcctccgcctagaaggacatcaattttgtgcttgccgttgaccatctcatcaaaataatcatccgcaattgagttcatattttttcggctgtggtcgtgtgaaccgaaagaggccggagtggcgtgtgtaatttctgaagtagccacaagtcctgttgcttttcctttttctttcgcagcttcaagcaccgttttggcttctgacccgtcgttatccacggctatggcattattgtatgttttaattcccgcagacatagccgttgccgccgctgcagaatctgttacattttgttcaggatcatcggggtaagttgtttgctggccgacaagatactgatcaaaagccgtaggctccacaacttttgtctttttattatcctttaagtatcgataagcggacgtataagacacacccataccatcaccaatcagaacaataacattcttaatttcgtcttggtttccctttttcttttcctgggcgctggcatcaggcacactgccgctggctaagctgctgaacgcaattgatgataaaaccgcgataggcagtaatttcttcgggaattttttcaactggataacctcctaaatatagatgaatcactatgacaacccaattatatttttaaactgttaagctagtattaatcgattttaaagattggatttacaagaataatgaactgctatcaaaagaaggaaagagtgatagtactaaagaaataaattggaggaatagatactggccgtggatagtcggactgaaatctgctatagtcgcatagaagcaacccgcttacatcttgaacaattttaagtattatgttggaaagaggtattgtgtaagcacatgtctgagcaattcatatggagtggcatcattttattttaggagggaacaacatggacgttttttctgagtacttagcggggattgatgacccgttccaccgagaaagaacggaagaggtgttaacttggatcaaagataaatatccaaatttacatacagaaataaaatggaatcaaccgatgtttacggatcacggtacatttattattggctttagtgtttctaaaaagcatttagctgtcgctcctgaaaaagtaacgatagcgcacgtagaggatgatattgtgaaggccggatatgattacaccgagcagctgatacgtatcccttggaatggtccagttgattacacgctacttgagaaaatgattgagtttaatattttggataaggcggactgctccactttttggcggaaatgaagaaaaaggcataacatatgggctgtataaaatatgttatgccttttcatttgtctatttttcgttttgatcatctattgctgcttttcatcaaacaaggtcttttcattgagcgcaagctgactcgcagaataatgattaccttgtttccatttcacttcaatcgtaatatcatggccttcaagctcatgttcatctaaccgctctaaaaaagaaacggacttttcctttgcgcttccatcagaaaaagtgcctccagcataatcatgcatcaggatttccgtgtcagaactcagcagaacttcatcatccttttttacaatcagtgattccaaataagtgttgtctatttcaattgtatcaccgatccaataaagtttgccgctgtattcattcggtgcatcttcattttttgtgaaaacagcttcccaattctgatctttgctttctccctgccaattcggatactccaaacgaacatgatgaatcaggtgataggaaaaaaagatcaagcagaaagcgattaataggaatgccgtgaaaatgagagggtatttataatgactggacataaaagactcctattcgtttaatcaattaccttcgaaaatagaatttcatcccgaatcaaaatgccgttttcagccacctcgggaatctctggcttgagtcggcgcgctttttcaactgcgtttggaaacactgcggcgaattgatagcctctcttttgataaaacgccatcgcatgtacattatcattcgttgtgataagctttattcgttgacaatgtgcatatttagccgtctcttcaacctgctgaagtaaagctgtgccgattcctttattttcaatcatactatctaatgaaataatttcacaatctttcccatctattgtgtatgtaatacagccaatgatttcgccgctttcatttactgcggcaaatccatctaattcatcacaccgaaaaatgccgctggaaatcgccatctcgggtgtaccccaatgcttggcaaaaaaatcggtcaacatatgttttgctatctcattgtttgggatgatgatcatcgtaacactcctctattgaaagattgcatgtgtactatcaatataaacaatatataacaaaaaaatagacattgaggtgacagcatggaaatcagcgatgttatttacgggcaccaccatatagacggagtgctggaagagcttatcaaaagcgctcctgtgcaaaggttaaaagggatctatcaaggcggagcaagctttttagtgaatcgaaagtggaacgtgaccaggtatgagcactccatcggcgtgatgctcctcatcaaaaagctcggaggaacgatagaagaacagattgcaggtctgctccacgacgtatcacacacagctttttctcatgtggtcgacgttgtctttgaaaatcaagcagaagactatcatgaaaacatctttcaacaagtcattgttcactctgaaatcccggacattttacaaaaacacggctatcatactgaagaacttttatctgacgattcaaggtggacattgctcgaacagcccgcaccggagctgtgtgctgatcggacagactatacgctgcgtgatatgtaccgatatggacacattaacctgcacgaagcgcaaacctttttggatcatcttattgtgagaaacggaaggatgtttcctgatagtattgaagccgccgaatggtttgtcagtgtgtactacaaggaagtaattgatttctttttgaatcccgtgaatgtatatggatatgaatatttagcgcgagcattgaaggcagcgttgcggcatgatgtcatatccgcagaggatctgctgaaaacggaccaagaggtactgaacatcctgcgtgcatcaaaaaatgaagaagtcctgagcttgcttacatccattcatcccggcatacaagtaatagaagatgacatccagtacgatttccatcaaaagaagaaaatgcgcctaatcgatccatccatttttcttgatgacaaatggatcaaatcctcagatgtttctgaaaaggtgaggaaaatgggtgaggccgcttatcaaaaagcaaaaaaaggtgtgtatattaaaatcttaaatcagtaattgccgcctgacagcggcttttttcatgtttggctttgcaaacaaaggggaataggacaaactgcgggaacgctttatgagaatatcagcgtatttacataccgttcggggtatagtattatcgagagggcatgttttcattgtctgcgggcaaaagttacagtaaaaaaatgaagcaaaggagaatgaacatgaaaatctctaaaaatgcactgggaattctgatgttatctcttgtttttgttttatcagcatgcggcaataacaacagtacgaaagaaagcacacatgacaatcattcagactcctcatcacatgaagagatggaccattccggatcagctgacgttccagagggattacaggaatctaaaaatccgaaatacaaagtaggcagccaggtaatcatcaatacttcccatatgaaaggcatgaaaggtgctgaagctacggtaacaggcgcctatgatacaacggcgtatgtggtttcttatactccgactaatgggggacagcgtgtggatcatcacaaatgggtgatccaagaagaaatcaaagatgccggagataaaacgttacaacccggagatcaggtgattttagaggcttctcatatgaaaggcatgaaaggagcaacagccgagatcgattccgcggaaaaaacaactgtatacatggttgattatacatcgacaacaagcggcgaaaaagtgaaaaaccacaaatgggtcaccgaagatgagctttcagctaaataataaaaaatcctccttttacaaggaggatttttttgctgtttgaacaggtcttgttaaagaaatgaaagcaaacaggacagcgatgatcacaatcgatccgccgcaccatgctgttgacaccacagtacccgtctgatccaaaacaacaccgccaatggctgagccaagggcaattccgacttggagggccgatgtgttaaagctttgctgaatgtcagacgaatcaggtgcaatttcaattaaatagctttgctgagccggggcgaggctccagctcagaagaccccaaatcaccatgacaggcaaaaagaaaatcatagacgatgtagacagcggcagtaagaacataatgatggcaaaggaaccggtcaccagcaaaatgctcttaaaggaaccaagccggtcagatagcgctcctccgaaagggcctccgcatacagcagatatcccgaaaaggaaataacaaatgctgacccagaaagagctcaggtgaagagtctcttctaaaaacggcgcaaagtaagcgtaaagcgtgtagtggccagctaatgtaaacatcgtgacgaggtgtgaactcgcgattttcagattaccgatcgtcttgagttgttcccggaaaggaatcattttctccgccggtattctttcaaagaagattgaaataatcagcatggagatcagtgccaacaggccgatgccaaggaacaaaatccgccacccgaaggaatcgctgattaagattccgagcggcacgcctaatgcgatagcagagctgaatcccataaaaataattccgattgcgcgggctctgtattcaggcgctacaattttcggggcaattgttaaagaaagcacaacaatcagccctgtactcattgctgccaataccctagataccatcagtgttgcgaaattagggctgaaataggcgacaagattgctaaggaagaaaacaaataaagcaattagatataagcgcttccgctcaatcttcgcagtcaatgccaaaagcagcggcccagatactgcatatcccagcgcaaacacactgatcagctgtccggctgaaacaatggaaatgtctaaatcatttgcgatctgaggaagaattcccccacaattaactcaaccaatccgactgcaatcgtagaagctgcaagcaggaaaactttgaaattcataacaaactcctttacttaaatgttttgataaataaaaaaaatcctgattacaaaaaatgtcataaacaaattttgtaatcaggattttacggttcctggtagacaccctcaaaccatattattgaggttatacaagtgataatagctatttaattgattcgtttccgttgatgagtgtaccacattatgaatgaatcttccatagaaaaatttacaaaatgatgaaccggacaagcgtatgattatatttattttataaaagtatagacatttaaaaataaatgactataataatcggtgtaagcgttttaatcacaagggggaatagcagttgaaaaaaatattactcgcgtgcagttcaggaatgtctaccagtttattggtgacaaaaatgaaggaatacgcacagtctatcggtgaggaagcagagatttgggctgttggccaggataaagcaaaagaagacatgagaaaagcggatgccgttttgatcggtccgcaaatgagctttctgaaaagcgaactccaaaaagaagcggatcaatacaacattcgggttgaagtcattgacatgatggcctacggaatggcagatgggaaaaaagcgtatgagcaggcattgtccttaatggagaatcaataatggaacaggtgaaaatcacgaatttaacagacgaacaaatcagttttcagcttatcctgcacagcggcaatgcccgcagctgcatcatacaatcactgcgcgcctacaaagaaggaaacaaggatgaggcggatgctctcattgccaaggctgagcaggatttatccgcggcccatgacattcactttcaaatgatacagaaggaatccggcggagaagcacaagctttctcattgctgctcatgcatgcggaggatcacctgatgtcaacattatccatgaaagaattagtgaaagagatgcttgatatttttaaaaccaagaatctataaataatcggggtggatagggtgttcgagaaaatcagccaattccttgttccaattgcagggaggttaaacaataaccgttatttgcaagtgctgcgtgatgcatttatgctggctttcccgcttacgatattcgggtccatttttgtcgtgttaacgaatttgccgtttctaaacaaaatcatgaatgcctcaatgcttacatcgtttcagtctcatttcggcattgcctccacggcgactatgggcattatgtctgtctttgttgtgttcgggataggctattacctgtcaaaaagctatcaggtcgaagctgtatttggcggagcgatcgctttggtttcctttttgctcttaacgccatttatcgttcagccggaaacaggagatgccgttacaggggttattccggtcgaccgtctcggtgcaaaagggatgtttcttgggatgattacggcatttctttctggcgaaatctacagaagaatcgttcaaaaaaacctgacaatcaaaatgccagctggcgttccgcctgctgtagcaaaatcatttgccgcacttattccggcttttatcacattgaccgtatttttgctgattaacataatggtgactctgttttttaaaacaaatatgcacgacgtcatttatcacgcgattcaggctccgcttgtcggacttggaagcggtatcattccaacgctgattgccgtgtttttcattcaaattctttggtttttcggactgcatggacagatcattatcaactccgtgatggacccgatttggaatacactgcaggtagaaaacctttctgcttacacggcgggaaaagaaatccctcatattatttcaaaaccgtttatggagatttatacagtagggatgggcggaaccgggatgacgcttgcgattgtgtttaccattctcatattcatgaaaagcaggcagatgaagcaagtatcaaaacttggcctcgctcccggtatttttaacgtaaacgaaccgattatcttcgggcttccgattgtcatgaatccgatcattattgtgccttgggtgctggcaccgatggttgttacgctcgtcacctatctggctatgtcagccgggctcgttccgcctccgactggtgtgacagtgccgtggacggttccattattcattaatggcatcatggcgacgaactcaatcatggggggcgtgatgcagcttatcaatctgctgattgtcttcgtgatctggtttccgttcctaaaagcaatggataaattaaatctggcaaaagaaaaagaacaggctgtgcaggagacagctgctcagcaaaatgataacagcataaaaatgtgacataaggggagagagacttggcacaaacagaacaatatcgttttccaaaggatttttggtggggatcatcggcttcagcaacacaaacggagggtgccgccgacagagacggaaaaggccagaatatatgggattattggtttgaaaaagaaccgcatcgtttttttgatcatgtcggccccgcagacacatcccaattttacgacaactataaagaagatatcaggctgatgaaggagcttggccacaactcgttccggatgtcgatttcctggtcacgtttaataccaaacggaacgggcgagatcaacgatacagccgcagatttctataacaatgtcattgatgagttgatcgctaacggaattgaaccttttgtcaatttgtttcatttcgatatgccgatggcgcttcaaaaaatcggcggctgggtcaatagagagacggttgacgcgtatgaaaactatgcaagaacttgcttccgtttgtttggcggccgggtgaaaaaatggtttacgcataatgaaccaatcgttcccgtggaaggcggatacctatatgattttcattacccaaacaaggtcgactttaaagaggccgtccaggttggatttcatacgatgctatcaagtgcccgcgccattcaggcttacagggagatgaagcaggacggaaaaatcggcatcatcttaaatttgaccccttcatacccgagaagcagccatccggcggatgtgaaagccgggaaaatcgcagacgcgttttttaacagatcttttttagacccatctgtcaaaggcgaatttcccaaagagctggttgacattttgaagcatgaaggctttatgccagattacaacgctgaagatcttgacatcatcaaaaagaacacggttgacctgttgggagtgaattattaccagccgagacgtgtgaaagcgaaagaacatcttccgaatcccgacgctccttttttaccggacaggtattttgatccctacgtcatgccgggccgcaaaatgaatccgcatcgcggctgggagatctatgaaaaaggcgtttatgatattttgatcaatttaaaagaaaactacggcaacatcgagtgttttatctctgaaaacggcatgggggttgaaggtgaagagcgcttcagggatgaacaaggcatcattcaagatgattaccggattgaatttataaaagagcacctcaaatggattcaccgcgccatacaggaaggctcgaacgtaaaaggctatcacttatggacgttcatggacaactggtcttggacaaatgcctataaaaaccgatacggatttgtatcagtcaatctcgagaaagacggagaaagaaccgtcaaaaagagcggaaattggttcaaaaaggttgctgagcaacacggtttctagattttcctaaaggtcaagatcttccggcaatcatcataacgaatagagatgacgaaaatccgcaacattgatgaaatagggaaaagaacttatgatatccgtaaaagcttatgtgatatcaaactctaacagctgccggaggataccaatgaataaatatgaaatcattgcaaatgaaatgagaaatagaattaaaaataacgtatatccgatcgatcagcccattcctgatgaagtatctcttgcaaaagaatttaactcaagccgcatgacgatgaagagagccttggataatttagttgccgagggtctgctgtttagaaaacgaggccatggcacgtttattattcaatctgcaatacaggatgaccatgtccatgtagtcagcaatgagattctcggattgaccaacttgctgaaagataaaaaaatccaaagcaaggtcattcagtttgaagtgcaatttcccactgaggaagtggccgcccatttgtctattgatcagaaaacaccggtttattatgtcgttcggctgcgaattgtagaaggtgaaccctatgtattagaaaaaacatatatgccgactcatttaataccgggcattaatgacgatgtccttcatgattcgatctacaatcatattacaaatgtgctgcagctcaaaatcgccggaacgcatcggaaaatcagagcctgcaaatctgatcatattgaccagcagcatctgggctgtaaacaggatgatccaattcttgaagtggaacatgtgggcttcttagataccgggattccatttgaatattccttttcacgtcatcggcatgacaagtttgttgtgacttctgtaaacatacggcgctgattgcggagacaacaaggaggccatctgcatgcttggcggtattgaagcaggcggcacaaagattgtttgtgctgtcggtaaagaagatggaacaatcattgaccgaatagaattccccacaaagatgccggatgaaacgatagagaaagtaattcaatattttcgccaattttcattacaggcaatcggcatcggttcctttggtcccattgataacgataaaaccagtcaaacatacggtaccattatggccacgccgaaagcgggctggagacactatcccattttgcaaaccgttaagaacaaaatgaaaatcccagtcggatttagtacagatgtcaacgctgcggcgctgggtgaattcattttcggtgaagcgaagggtattgacagctgcctgtatataacgattggcactggcatcggagcgggggctattgtagagaggaggctccttcaggggctgtcacacccagagatgggccatatttatatccggaggcatccgtctgacgtataccaagggaagtgcccttatcatggagattgctttgaaggcttggcttccggtcccgccattgaagcgcgctgggggaaaaaagccgcggatttatcagatatagcacaagtctgggaactggaagggtactatattgcccaagcactggctcagtatattttgatccttgcacctaaaaaaatcattcttggcggcggcgtcatgcaacagaaacaagtgttatcttatatctatcaatatgtaccgaaaatcatgaacaactacttagatttttctgaattgtcagatgatataagtaattatattgtacctccacgtttaggctctaacgccggaatcatcggcacgctagttttggcgcaccaggccttacaagcagaggcagcatccggggaggtgcgatcatgacgcatcctttatttttagagcctgtctttaaagaaagactatggggagggacgaagcttcgtgacgcttttggctacgcaataccctcacaaaaaacaggtgagtgctggaccgtttctgcacatgctcatggcccgtcggctgtaaagaacggcccgctggcaggaaagacactagatcaagtatggctagatcatccagagattttcggttttccagataggaaggtgtttccgctgctggtaaagctgctggacgctaatatggatctctcagtgcaagtccatccagatgatgattatgcaaaactgcacgaaaatggcgaccttggtaaaacggagtgctggtatatcattgattgcaaagataacgccgaactaattttgggacatcatgcaagcacaaaggaagagttcaaacaacgaatagaaagcggtgattggaacgggctgctgaggcgaatcaaaatcaagcccggagatttcttttatgtgccaagcggtacactccatgctttatgtgagggaacccttgtcctggaaatccagcaaaactctgatacaacgtatcgcgtatacgattatgaccgctgtaatgaccagggccaaaaaagaactcttcatatagaaaaagccatggaagtcataacgataccgcatatcgataaagtgcatacaccggaagtgaaagaagttggtaacgccgagatcactgtttatgtgcaatcagattatttctcagtgtacaaatggaagattagcggccgaactgcttttccttcatatcaaacctatttgctggggagtgttctgagcggatcaggacgaatcataaataatggtagtcagtatgaatgtaatgcaggctcacactttgtcttgcctgcgcattttggcgagttttcaatagaaggaacatgtgaattcatgatatctcatccttaatgaatgggggagttgcatttgtttaagaaacatacgatctctttgctcattttatttttacttgcgtctgctgttttagcaaaaccaattgaagcgcatactgtgtcgcctgtgaatcctaatgcacagcagacaacaaaagcagtgatgaactggcttgcgcacctgccgaaccgaacggaaaacagagtcctttccggagcgttcggaggttacagtcatgacacattttctatggctgaggctgatagaatccgaagcgtcaccgggcaatcgcctgctatttacggctgcgattatgccagaggatggcttgaaacagcaaatattgaagattcaatagatgtaagctgcaacagcgatttaatgtcgtattggaaaaatggtggaatccctcaaatcagcttgcacctggcgaaccctgcttttcagtcagggcattttaaaacaccgattacaaatgatcagtataaaaaaatactagattcttcaacaatagaaggaaagcggctaaatgccatgctcagcaaaattgctgacggacttcaagagctggagaaccaaggtgtgcctgttctgttcaggccgctgcatgaaatgaacggtgaatggttttggtggggacttacattatataatcaaaaggataatgaaagaatctctctatataaacagctctacaagaaaatctatcattatatgaccgacacaagaggacttgatcatttgatttgggtttactctcccgacgccaaccgagattttaaaactgatttttacccgggcgagtcttacgtggatattgtcggattagatgcgtattttcaagatgcctactcgatcaatggatacgatcagctaacagcgcttaataaaccttttgcttttacagaagtcggcccgcaaacagcaaacggcagcttcgattacagcctatttatcaatgcaataaaacaaagatatcctaaaaccatttactttctggcatggaatgatgaatggagcccagctgtaaacaagggtgcttcagctttatatcatgacagctggacactcaacaagggagaaatatggaatggtgattctttaacgccaatcgttgagtgaatccgtaatgtcacaattaagaaggtgctcaagaagtttcttgagcaccttcccactggattaagcattcatatcgcctaacccaggactgtgttcatttggtatttcaggaagcactggtacgggaaagcctgccggaggatctattacttgtaactctccgccatttcggcttggagatttcccttgatagatttcactgattctcgtttcatccaacctaaagttaaactgtgcattatggtagcctaattcgacatactttctgcactcaggatatttattaatgtcataattcggcacagggagcagcttcgcccattcaacgcccaatgtctcgagcgctttcgcgaatgcattctggtgagcattgtcgcgtacaatcagaaaagcaagtgtttcgcggaacgtctgattagagctcatttcataaattcttgttttttgcagcacacctgtcgactcaagaagcaggttatccagcaggtcagtaattaagtttccgtggttatacacccacgacccgttccacggattgccccctgcatcaacaggaagggaactttgcgctccaataatataatgatgaggattagcatgtttaaccgcttcatcaagtggcgcttgatctgtaccttgactgccgacaccttcaccgcctgattcatctaataaagcattgattgtgttttgaaccagttcaacgtgggcaatctcctctaaaaaaatgccgcgaagcagatcgcgatactgtttctgctttcctctgaaattagagctttggaaaaaaaactgcatcattgtacgcatttctccgtaatgaccgcctaatatctcctgcaggaccttagcagctgccgggtctggcttgtccggtttaatgatattaatcagttcctctttgtagtaatacataacacgcctcatttcttcttaagagattttcttatattatttgtaagatgagataaaatatatacatgataagcatgggaaggcgtgaaagaagaaaataaaaaaatacaggaaaagtgttgaccaaataaaacaggcatggtatattattaaacgtcgctgatgaacagcgtgaaacaaaacagaaaaacaaaaaagtttttctaaggtgtttacaagatttcgaaaatgtgtataataagataagtcgaattgaaaaagattcgaaaaacatttttaaaaaacttcttgacttcaacatcaaatgatagtatgatagttaagtcgcttgataagcgcccgtagctcaattggatagagcgtttgactacggatcaaaaggttaggggttcgactcctctcgggcgcgccatataagataccacgcgggtgtagtttagtggtaaaacctcagccttccaagctgatgtcgtgagttcgattctcatcacccgctccattattgaatgatctttgaaaactaaacaagacaaaacgtacctgttaattcagtttttaaaaatcgcacagcgatgtgcgtagtcagtcaaactactttatcggagagtttgatcctggctcaggacgaacgctggcggcgtgcctaatacatgcaagtcgagcggacagatgggagcttgctccctgatgttagcggcggacgggtgagtaacacgtgggtaacctgcctgtaagactgggataactccgggaaaccggggctaataccggatggttgtttgaaccgcatggttcaaacataaaaggtggcttcggctaccacttacagatggacccgcggcgcattagctagttggtgaggtaatggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtaccgttcgaatagggcggtaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggacgtccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaaccttttaggagccagccgccgaaggtgggacagatgattggggtgaagtcgtaacaaggtagccgtatcggaaggtgcggctggatcacctcctttctaaggatattatacggaatataagaccttgggtcttataaacagaacgttccctgtcttgtttagttttgaaggatcattccttcgaaacgtgttctttgaaaactagataacagtagacatcacattcaattagtaacacaagatatcacatagtgattctttttaacggttaagttagaaagggcgcacggtggatgccttggcactaggagccgatgaaggacgggacgaacaccgatatgcttcggggagctgtaagcaagctttgatccggagatttccgaatggggaaacccaccactcgtaatggagtggtatccatatctgaattcataggatatgagaaggcagacccggggaactgaaacatctaagtacccggaggaagagaaagcaaatgcgattccctgagtagcggcgagcgaaacgggattagcccaaaccaagaggcttgcctcttggggttgtaggacactctgtacggagttacaaaggaacgaggtagatgaagaggtctggaaaggcccgccataggaggtaacagccctgtagtcaaaacttcgttctctcctgagtggatcctgagtacggcggaacacgtgaaattccgtcggaatccgggaggaccatctcccaaggctaaatactccctagtgaccgatagtgaaccagtaccgtgagggaaaggtgaaaagcaccccggaaggggagtgaaagagatcctgaaaccgtgtgcctacaagtagtcagagcccgttaacgggtgatggcgtgccttttgtagaatgaaccggcgagttacgatcccgtgcaaggttaagcagaagatgcggagccgcagcgaaagcgagtctgaatagggcgcatgagtacgtggtcgtagacccgaaaccaggtgatctacccatgtccagggtgaagttcaggtaacactgaatggaggcccgaacccacgcacgttgaaaagtgcggggatgaggtgtgggtaggggtgaaatgccaatcgaacctggagatagctggttctctccgaaatagctttagggctagcctcaaggtaagagtcttggaggtagagcactgattggactaggggccctaccgggttaccgaattcagtcaaactccgaatgccaatgacttatccttgggagtcagactgcgagtgataagatccgtagtcgaaagggaaacagcccagaccgccagctaaggtcccaaagtatacgttaagtggaaaaggatgtggagttgcttagacaaccaggatgttggcttagaagcagccaccatttaaagagtgcgtaatagctcactggtcgagtgactctgcgccgaaaatgtaccggggctaaacgtatcaccgaagctgcggactgttcttcgaacagtggtaggagagcgttctaagggctgtgaagccagaccggaaggactggtggagcgcttagaagtgagaatgccggtatgagtagcgaaagaggggtgagaatcccctccaccgaatgcctaaggtttcctgaggaaggctcgtccgctcagggttagtcgggacctaagccgaggccgaaaggcgtaggcgatggacaacaggttgatattcctgtaccacctcctcaccatttgagcaatggggggacgcaggaggatagggtaagcgcggtattggatatccgcgtccaagcagttaggctgggaaataggcaaatccgtttcccataaggctgagctgtgatggcgagcgaaatatagtagcgaagttcctgattccacactgccaagaaaagcctctagcgaggtgagaggtgcccgtaccgcaaaccgacacaggtaggcgaggagagaatcctaaggtgatcgagagaactctcgttaaggaactcggcaaaatgaccccgtaacttcgggagaaggggtgctctgttagggtgcaagcccgagagagccgcagtgaataggcccaggcgactgtttagcaaaaacacaggtctctgcgaagccgtaaggcgaagtataggggctgacgcctgcccggtgctggaaggttaagaggagcgcttagcgtaagcgaaggtgcgaattgaagccccagtaaacggcggccgtaactataacggtcctaaggtagcgaaattccttgtcgggtaagttccgacccgcacgaaaggcgcaacgatctgggcactgtctcaacgagagactcggtgaaattatagtacctgtgaagatgcaggttacccgcgacaggacggaaagaccccgtggagctttactgcagcctgatattgaatgttggtacagcttgtacaggataggtaggagccttggaaaccggagcgctagcttcggtggaggcatcggtgggatactaccctggctgtattgaccttctaacccgccgcccttatcgggcggggagacagtgtcaggtgggcagtttgactggggcggtcgcctcctaaaaggtaacggaggcgcccaaaggttccctcagaatggttggaaatcattcgcagagtgtaaaggcacaagggagcttgactgcgagacctacaagtcgagcagggacgaaagtcgggcttagtgatccggtggttccgcatggaagggccatcgctcaacggataaaagctaccccggggataacaggcttatctccccaagagtccacatcgacggggaggtttggcacctcgatgtcggctcatcgcatcctggggctgtagtcggtcccaagggttgggctgttcgcccattaaagcggtacgcgagctgggttcagaacgtcgtgagacagttcggtccctatccgtcgcgggcgcaggaaatttgagaggagctgtccttagtacgagaggaccgggatggacgcaccgctggtgtaccagttgttctgccaagggcatcgctgggtagctatgtgcggacgggataagtgctgaaagcatctaagcatgaagcccccctcaagatgagatttcccattccgcaaggaagtaagatccctgaaagatgatcaggttgataggtctgaggtggaagtgtggcgacacatggagctgacagatactaatcgatcgaggacttaaccatatttttgaatgatgtcacacctgttatctagttttgagagaacactctcaatttgtttggtggcgatagcgaagaggtcacacccgttcccataccgaacacggaagttaagctcttcagcgccgatggtagtcggggtttccccctgtgagagtaggacgccgccaagcattacttttatcatcgcggggtggagcagttcggtagctcgtcgggctcataacccgaaggtcgcaggttcaaatcctgccccgcaaccaaatatatgattaaataaggagtgccctaagggtgcaaccaaaataatcttatacaaatatggtccggtagttcagttggttagaatgcctgcctgtcacgcaggaggtcgcgggttcgagtcccgtccggaccgccattaatgtaaacgaaacgatcatgttttcgttttttttgtgttttcttttactgtatcttctgcttggtgtcatagccaagctttctttatatcgggaacatcttggatattccagcaaaattcgataaactaggaagagcacatataggcataagcagggttgaaaggagattttggttcatggatgaatttgatttgatacatagcattactccgcggaccattcaccattcttccgttgatgtaggaataggtgatgatgcagcgctctacactgcgaaacacggcgttcaggaaattgtttgtgttgatactatggtagaagacgtacacttcaaattacactattcctcacctgaagatatcgggtataaggcgttagccgttaatataagtgatattgccgcgatgggaggcattcctaagttttatctggtatcacttgcgataccttcaaaatggactgaatctgaaattaaggcgatgtatgaaggaatgaatgaactggcgaaactatatcatatggatctgattggcggcgatacagtttctaccgctgacaaattagtcgttacagtcactgtgatcggtgaaattgaaaagggacaggcctgtttgcgcagcttggcaaaaccgaatgatattgtgtttgtaaccggtgaaatcggttcttctgcagcagggctttctttattgctggaagagactaatcctcaaaactcatctgtggaaacggattactttatccacaggcataaacggcctgagccaagagtaagcgtcggcagattatgctcgatttttaaacgggcagctttaaatgatgttagtgacggattggctagtgaactgaacgagattgcagaagccagctgtgtttcaattgaaattgatgaaagcatgcttccaattcattctgatttgcctaagcttcatcctaactggaaagaatgggctttgtttggcggtgaggattttgagctgacagggacggtttcaaatgaggagtgggaagtgttgaagcaacagtgcgcagcacgtcaacttcccattacaaagattggccatgtcagggaaaaaacaaaatctaaagtgatcctaaaaacagatcaaacatcaatgatcttagagaaaaagggatataatcattttaaataagacgggtgacttgtgtgaagcaattaaaatggagaactgtaaatccagaagaaacaaaagcaattgccaagctgacggcatcgtttgctaaaccgggagacgtcctgacattagagggcgatttaggtgcaggaaaaacgacttttacgaaaggttttgcagaagggctgggaattacacgtgttgtaaacagtccgacttttacaattataaaagaatataacgatggcgtacttcctctttatcatatggatgtgtatagaatggaagatgaaagtgaagatttgggacttgatgaatattttcacggacaaggtgtctgtctcgttgaatgggctcatttaattgaagaacagctgccgcaggagcgactgcaaattgtcatcaaaagagctggtgatgatgagcgggaaattacctttactgctgtcgggaatcggtatgaaatgctttgtgaggagttaagtagacatgacaatattagcaattgatacatcaaattatacattgggcattgcgctgcttcgagaagacaccgttatagcagaatacattacatacttgaaaaagaaccactctgtaagagcgatgcctgctgttcattcattgctgaatgattgtgatatggcaccgcaggacctttctaaaattgtcgttgcaaaaggccctggttcatacacaggagtaagaataggtgtgacgttggccaaaacacttgcctggtctttagacattccaataagtgctgtatcaagtcttgagacgcttgcggcaaatggtcggcattttgacggtctgatcagcccaatctttgatgctagacggggacaggtgtacacaggtctgtatcaatataaaaatggacttttagagcaagttgttccagatcaaaatgtgatgctggcagattggctggagatgctaaaagaaaagaatcgttctgttttgtttttaggtcacgacacttctattcacaagcagatgatcgaggatgtgcttggaacaaaagggttcattggaactgccgcccagcataacccgcgtccttcagaattggcttttctcgggaaggaaaaggaagcagctgatgttcatgggcttgtcccggattacttgcggctggcagaagctgaagcgaaatggattgaaagtcaaaagtagggtgataggatgaaaacaaaagcagcggtcagaaatatgcggcttgaagatatagatcacgtatacgaaatcgaagcatcctcctttacgtctccttggacgaaggattcgttttatcatgagctgctggaaaatccgtatgctcattatctcgtgattgaaaaggacggccatcttgctgggtattgcgggatttggattgtgatggacgatgcccaaattacaaatatagcgataaaaccagagtatcgcggccagtctttaggagaaacgctttttcgctcagctgttgaactgtgcaaagaaaaagacgcaaggcggctttcgcttgaagtgagggtttcgaatcatcctgctcaaggcttatataagaaattcgggatgcagcccggcggaataagaaagaactattatactgataacggggaagatgcgttaattatgtgggtgacgataaatgagtgagcaaaaagacatgtacgtattaggaattgaaacaagctgtgatgagactgctgcagctattgtgaaaaacgggaaagagatcatttcaaatgtagtagcctctcaaattgaaagccataagcgcttcggaggcgttgttccggaaattgcttcaagacatcatgttgaacaaatcactttggttatagaagaggcttttcgcaaagctggcatgacgtatagtgatattgatgcgattgcagtaacagaaggtccgggactggtgggagcgcttcttatcggagtgaatgccgctaaagcattgagctttgcacataacattccgttagtaggcgttcatcatatagccggtcatatatacgcgaaccgtcttgtagaagacatcgtgttcccggcactggcattggtcgtttcaggaggccatacagaactggtttatatgaaggaacatggatcatttgaagtcattggggaaacccttgatgatgcggcaggagaagcctacgacaaagtggcgcggacgatgggattgccatatccgggtggaccgcaaattgacaagctagctgaaaaagggaatgacaatattccgcttcctcgcgcatggcttgaagaaggctcttacaacttcagctttagcggattgaagtctgcggtgatcaatacgcttcataatgcatcccaaaaagggcaagagattgctccggaagatttgtctgccagtttccaaaatagtgtgatcgatgtcttggtaaccaaaacggcgcgcgcggcaaaggaatatgatgtcaaacaggtccttttagccggaggagtagctgcaaacagaggcctcagagctgcattagaaaaggaatttgcccagcatgaagggattacgcttgtcattcctccattagctttatgcacggataatgctgcgatgattgctgctgctggtacaattgcttttgaaaaaggaattcgcggtgcatatgatatgaatggccagcccggccttgaattggcttcttatcaaagtctcacgagataatagcgtgagactttttatatgtttgttattaacagacaattcacaatttatccacatgtctgtgagtaattatagagatattgatggataaagggctgaggtcactgttaataaagtggataaattcagaatattttgtggatagtgtgtataaagcgcttactttgtttatttattaggggatgttctgtggataaaaagcacctctaaaaagaggtgcttgacttttttaatcttcttctgtggatagttcttcccattcggccaaaagagattccagctcctgattaagcttctcattgtctgcatggatagcttgtactttttcatgatcctgatagacttcagggtcacatagcaattcatcattgcggctaatgttctcttcaatggtttgaacagtggtttcaatttcttcaatccgacggaggcgttggcgctctttctttttccattctttttcttcctcgtaggaacgtttggagtcagacttcactgtagctggcgttttatcagtttcctcttgctgattcattttctccaattcaagctgctctgtttttttctctgtataataatcgtaatctcccagatactcctctatatggcttgaagaaagctccaatactcttgtggcgattctgttaataaaatatctgtcatgtgagacaaataacagtgtgcctggataatcaatcagcgcgttttcgagaacttctttgctgtctaaatccagatggttcgtcggttcatcaaggatgagaaagttggctttttgaagcatcagcttagctagagccaatcttgctttttcgcctccgctcagtgaatgaactggtttcagcacatcatctccggagaataagaaatttccgagacacgttctgatttctttttctgggagcccggggtactcgtcccacagctcatcaaggacacgtttagaggaagtcaactcagcctgttcctgatcataatagccgacactgacatttgagccgtatgagatcgttccttgatctggttttagggtgtctatcaatgttttcagcaatgtcgatttaccaattccgttagggccgacaagcgctgcgctttctcctcttgtgagcatgaatgacacttctgttaaaagcggcggctggttttcatagctgattgtgagatcctgaacacggaggacttcatttccgctctgttttgtaatatcaaaatgaaagtttgcagatttttcatcgccaagcggttttgacatgacttccattcgctcaagctgctttctgcggctttgcgcccttttggtggtagaggctctcgccagatttcggtctacgaagtcctgcagctttgcaatctcgtcctgctgcttttcatacattttcagatctttttcatactgcgcggctttttggtcgagataagcgctgtagttgccgtgatactttttgctttctgctcttgatacctcgtacacctggtttactactttgtccaaaaagtagcggtcatgcgaaacgatgaggatggcgcctgaatagccttgtaaataatgctcaagccaggtaagcgtatcaatatccagatggtttgtcggctcatcgagaatgagcaaatcaggctgtgttaacagaagcttacctaaagccagtcttgttttctggcctccgctgaggctttgaacctgtgtagaatcgtcaaaatggctgaagccgagaccatgcagcacagatcttacatccgcttcatattgatagccgcctttatctttgaattcctgctgaaggcggtcgtaggttttcatgatgctttctaattcacccgggtcagctgccgccattttttcttccatagcccgcatttccttttccattgcttttaagtggtcaaaaacagtcagcagctcttcttttatggtaagcttagaatccaagccagtatgctgggcgagatatcccattgtaatatctttcggtttaataatttcgcccttttcatacgaaagctggcctgcgataattttaaggagcgtggattttccggcgccatttcttcctacaatggcgatgcgatcacgatttctgacttccagctttatattgtttaaaatagtatcagcaccaaatgatttggacagctgattaacttgtaagatcatcatattatttcacctctgctataataagttaagtgtagcttatgaaccagaagtcagcaaacaatacattggccatataagacatagagaagaaaatagtgtatgatctgtttaaggagcgttttaatatgaatggattttctcattttaatgaacagggcagagcccagatggtggatatcagcgaaaaatcttcgactgtccgtactgcggcggctgtttcaagcgtacacatgaagaatgaagtgtacgagaaaatacaaagtcacgatatcggcaaaggagatgtactggctgtcgcacaggtggcaggcattatggccgcaaagcaaacgtcgaatatcattccgatgtgccatccgctttcattgagcggggtagatatatcgtttgactggaaaataaaagaagcagaagttatacttcatataaaagcacaggtcaaaacgaaagggagtacaggtgtggaaatggaagcgctcacttctgcatcggtgtgcgctcttaccgtttacgatatgtgcaaggcccttgataaggggatggtcatcggccctactttcttgctggagaagacaggcgggaaaaacggtgactttaaaagagaactatccgagtataatttggaggaccaaaaatgaataaggatcaatcaaaaattccgcaggcgacggcgaaacggctgccgctttactatcgctttttaaagaatctgcatgcgtcaggaaaacagcgtgtatcatccgctgaactcagtgatgccgtaaaggttgattctgccacgattcggagggatttttcctattttggagctcttggcaaaaaaggatacggatataatgtggattatttgctgtcttttttccgaaaaacgcttgatcaggatgagatgacagacgtcatcttgattggtgtcgggaacttgggaacggcatttcttcactataatttcacaaaaaataataacacaaaaatttctatggcttttgatataaatgagagtaaaataggaactgaggtaggcggcgtgcccgtctataaccttgatgaccttgaacaacacgtaaaagatgaatcagttgccattcttacagtgccagcagttgccgctcaatccattacagacagattggtcgcattaggaatcaaaggaatccttaattttacgccggcccgtttgaatgtgccggaacacattcgaattcatcatatagatttagcagttgagcttcagtcactggtttattttttgaagcattattcagttttagaggaaatcgaatagagggaaaggaggagcccaaatatgccgatcggtcctggaagccttgctgttatcgcaatcgttgctcttattatcttcggtcccaaaaagctgcctgaattggggaaagcagcgggagacacacttcgtgaattcaaaaacgctacaaaaggattaacgagtgatgaagaggaaaaaaagaaagaagatcagtaagttaggatgacacgaatgaaagtgaatcaaatgtcgctgctggagcatattgctgagcttcgaaaacggttgctgattgtagcgctggcgtttgtcgttttctttattgctggattttttttagcgaagccgattattgtgtatctgcaagaaacagatgaagcgaagcagcttacgcttaacgcgtttaacctgacagacccgctttatgtgtttatgcagtttgcgtttatcatcggcatagtcctgacctcgccggttattctttatcagctttgggcttttgtgagcccgggtctctatgagaaagagcgcaaagtaacgctcagctacattccgatctctattttgctgtttttagcgggcttatctttttcatattatattttatttccttttgttgttgattttatgaagcggatttctcaggatttgaatgtcaatcaggtgatcggaattaatgaatattttcattttcttctgcagctgacgattccgtttggactgctgtttcaaatgccggtcatcctcatgtttttgaccaggctcggaattgtgacaccgatgttcttggcgaaaatcagaaagtatgcgtattttacgctgctggtgatcgcagccctgattacaccgcctgagcttctgtcccatatgatggtcacagtcccgcttttgattttatatgaaatcagtatccttatatcgaaggccgcctatcggaaagcgcagaaaagcagtgctgccgatcaggacgtgtcttcggggcaataataaaaaatccatttctcatgcgagaaatggattcagcgtgttgacaaacccccgcatttgttgtcaagcctgtgcgttggtgctcacgaatgaaaacattcgctccgctccaatgctcgcctttcctagacttcaagggttttcaatcacgctgaaaatgacaaaatcctaacacgaaagccgttttaggatttaatttgaatccatttctcattcagaaatggattttctttatttttggttctttttgattttaaatgaaaaggcgaacatcttaaaagaaatgctgatgttgtaagcggcgaacaccatcagcaggatggagtaaaatgaccacatgctgcctggcgagcttgcggcaagataagtaaagatgcaccctacggcaaagtagatcattccccaaactaccgggtttctcataaaaataatcctccaataatcaattgcatttgtgtgctctgttgttcaaggtaattccgaacaggctcaagctgcatgatgacgacgaatgtattcatcattaaatgggcgaaaatcggcacccatatccgttttgttctggcatataaaaaggcaaaggtaaagcccattgctgtatatagaagaagatgcttcaaatcagcgtgaacaataccgaaaataaccgagctgatcagtcctgcaaaaaagaaattcgttttttcgtacagcgcgccgaaaatgatttttctgaagatgatttcttctaatataggcccgacgatggaagaaacgataatcatgagcgggactgcctgaatgacatccagaatcgcttgtgtattttctgattctcttccgatgccaaaaacataatattcaatagagcctgctattccttgagagaaaagggcaatgaaaaaaccggctatcgcccaaaggatagaaagtccgattgagtccttctgtccgtttcgcagcgtttctttcggaacggttctcagaatgagcagaacaacaacgagacaggcgataaagctgataacggaccataatccttgtgcatgcagcatattttcatctgtaggctgtcctccggcataaccgaatttaaataacaagggaatcgcgattaatgcggaaaactgcatgatgatatatgtcaaaataataaaccaatactgttttctcaaatggtatgtactcctttgttaagtgggtttcgttcatctacagctattgtaacataatcggtacgggggtgaaaaagctaacggaaaagggagcggaaaagaatgatgtaagcgtgaaaaattttttatcttatcacttgaaattggaagggagattctttattataagaattgtgttagcactctttagtgctgagtgctaaaattacatattcatactattgaggaggttattacattgttaaagccattaggtgatcgcgttgtcattgaactcgtagaatctgaagaaaaaactgccagcggaattgtgttgccggattctgcaaaagaaaaaccgcaagaaggcaaaatcgtggcagctggttcaggtcgcgtgttagaaagcggagagcgcgttgctttagaagtaaaagagggcgaccgcattatcttctcaaaatacgcaggtactgaagtgaaatacgaaggtactgaatacttaatcttacgtgaaagcgacattttagctgttattggctaattcttaaataaaaacatttaaaaattcgaggaggtactgtaaacatggcaaaagatattaagtttagtgaagaagcccgccgcgcaatgcttcgcggtgtcgatgcacttgctgatgctgttaaagtaactttaggaccaaaaggacgcaacgtggttctagagaaaaaattcggttctccgttaatcacaaatgacggtgtaacaatcgctaaagaaatcgaactcgaagacgcgtttgaaaacatgggtgcgaagcttgttgctgaagtagccagcaaaacaaacgacgttgccggtgacggtacaacaactgcgacagttcttgcgcaagcaatgatccgtgaaggccttaaaaacgtaacagcaggcgctaaccctgtaggcgtgcgtaaagggatggaacaagctgtagcggttgcgatcgaaaacttaaaagaaatttctaagccaatcgaaggcaaagagtctatcgctcaggttgctgcgatctctgctgctgatgaggaagtcggaagccttatcgctgaagcaatggagcgcgtaggaaacgacggcgttatcacaatcgaagagtctaaaggcttcacaactgagcttgaagttgttgaaggtatgcagttcgaccgcggatatgcgtctccttacatggtaactgactctgataagatggaagcggttcttgacaatccttacatcttaatcacagacaaaaaaatcacaaacattcaagaaatccttcctgtgcttgagcaggttgttcagcaaggcaaaccattgcttctgatcgcagaagacgttgaaggcgaagcacttgcaacacttgttgtaaacaaacttcgcggcacattcaacgcagttgctgttaaagctcctggcttcggtgaccgccgtaaagcaatgcttgaagacatcgctgtccttactggcggagaagtcatcacagaagatcttggccttgacctgaaatctactcaaatcgctcaattgggacgcgcttctaaagttgtcgttactaaagaaaacacaacaatcgttgaaggcgctggcgaaacagacaaaatttctgcccgcgtgactcaaatccgcgctcaagtggaagaaacaacttctgaattcgacagagaaaaattacaagagcgtcttgctaaacttgctggcggcgtagctgtcatcaaagtcggcgctgcgactgaaactgagctgaaagagcgtaaacttcgcatcgaagacgccctgaactcaactcgcgcggctgttgaagaaggcatcgtatccggtggtggtacagcgcttgtaaacgtatataacaaagtcgctgcagttgaagctgaaggcgatgctcaaacaggtatcaacatcgtgcttcgcgcgcttgaagagccaatccgtcaaatcgcacacaacgctggccttgaaggatctgtcatcgttgagcgcctcaaaaacgaagaaatcggcataggcttcaacgctgcaactggcgaatgggtaaacatgatcgaaaaaggtatcgttgacccaacaaaagttacacgctcagctcttcaaaacgctgcgtctgtagctgcaatgttcttaactactgaagctgttgtcgctgacaagccagaagaaaacgctggcggcggaatgcctgacatgggcggcatgggcggtatgggcggcatgatgtaaaaccgacaaaaaacccttgatttacaaggggttgtcggcaacggacgtcatttttatgccctattgatccatttataaattttcgaggcttctcatgagttcactgaacttgtgagaagcttctttttttctgtcttttttgatgtgtaaataaacctgtgtagtatgtacgggcatacatggcatttatggaccgaaaacaaaagcaaaaaaggaatactgagtccttttctaaaatcgaagcagacttttttgccaaacacgtcatctgcaattgatattattttatctggcattttaccgtctcgataacgattagaaacgtttactatatatgactcgctttctttatggaagctatgtaagtatcagaatgcaatttcttccctatcttcaagatcaaaagtttcaggaaaggggtagcgccgaatagattttgacatattctaaataatcttttgggaactttacttgtaatgtgtcttctacttcattaatttccttgttactaacaggttgctctccgaaatcccattcaatcatatgaaatctccgcctcgatatgtaaaacccttctttatgtaagaagagttttaattttattcagcctttaaatatgtccggaattttatcttgccatattaatagcaattctctaaattgatcggtttcaattgagttttcatagggttcttctatcctaaaagagttttcaacaattgtcacatcttttttaatgagaacacttgtagcatttaactcaatctcaaaatcttcatatatcccttctaaaaccttctcaatgtaatctatatactcgttggcttgttcttctgtagcgatgttttcaatgaaatcagagaaaatactgatttcttctggcaatactattcctaaatcaccaaatggatcttcttcaaatttatatggatatttcatatgttatttcaccttcaagattattttttatataacgggtatgcagttgctattgttccatccttatttaaatacatttctatttttatacccgacgcagacatgcccctgaatttatttgagccgatttgctttttagtttggtaagcttcatcaatagcttttaatacatctgcacggttccactctcttgggaagaaactagaatcagctatttttttaacaccgtcaacctcaacctttgccatataaactccgtttttatcaggttttttttccgtaccctgaataatttttccgcccatcatactttcatggtgataaccaactgctttaccgcgtttatttatttctccatggtagatgtgcttcattgtacctgtggtatactttccattacccgaactgaaattagatgttgtagatttagttaaaatactctctttttgattttcaataatactttttaacaaaggagtattttttgcattatacgtattgtcaatatctttagctatccctacaagtgcaggttcatatttattttttaataaggggttaataaagtcttttccctttaaaagccctttattgacatgagcagcggctgttccaccttcaactactttacctactttagaaagcttggtagtcgtttgcactgcggcacctgcaccttttgggccaacgatatttcctatcgcataactgatataatgccctttttcgtatgcatcgccatttaccattttatcattccatgagtcgatcaggtttgtccagatgatttttgaataagagggcgcgcttaaaactgttgaaattgtttttgtgagttttagttcggtgggaagctgtgaatattcccatgtaccaacaaccaagtctttgacgccatatatcgtatcgtcaatcacatcgtcaattccatcattaactccgtcgacgaagtcaattactgtcttaccggtattgattacactttcaccgacggccttcagctgttttgcttgttcaagctgtaccacatactggagctgttcaggggtaagattctcatagccgaccttcttggcaatttctaagtattcatccggatcagtcactccgtcagctagcttcttcttcaattctttgatttctcgttctttcgcttcatctttcttgatcttcaaataaacttcagtctgtttctcaatatcgccttttttcttatgtatgtcactttcacggtacgccttggcgttgtagtgaatgggcgtagcgtttttgcctttgcctgtggattcctcaagcttttggaagtccttcttgatgaattgctcgtttggctctgactgggcatattcagtaacaagtgcttcatccacgcttcctaatttatcgactgtttttttacgtttgtcctctgcatctgcaagttcgtctttgaagtcttctgtcgagaacaaatcaagcggaagaatatcgtcgatatcatttaaaatatctttcatcgctttcttctgttcagacataatggattttgattttgtgtaggcgttagccagctcgtgttctaagaaggattcttctatatatgcatcagataagctggcgtcctctaaaatgcctgaaatacttgccaagaaagcaattttcatatcaagtaagtcaatccaatcgccagctacacctgcgtggtcttgataaaatgctttaatgttgtcagcacctttgccggaaaactcactgtcatctaaatcagctacagctttaaaagccttttttagattgaccatctgacttcttaattctttgtattcctttgcacgtctatctgcttctgaaagcagtgagttggcttcaaatactttcatgttcatatcctttcgtttgaatagctccaacaagattttaccatggggaaatgaagaaacagactaaatgtgatacaaaagtggtgaaatggtcaattttaactatgtcattttacctatctgaatctcttgtttgggttaccgccgacgcctatagctagaagggctttctacagttagatttatagaccgaaaaaaattgaaggttattgaaataaataactccctctcatagagagagagggagttatttatttttgttataaaaattcattgtaaaaaaagataaaactaataaaactagaaaatagactatgaaggttgagataaagttccaagagaaaaagttaaagtctttatttagagaataaaatacaatttgacttactaaagttattacgaaaacaactgttattaatttagagaattttttggtcatgacaaaacacctcttccaatttagttaaataaacccatttaatatagtagaatgtttggtaaaatatagtatgtaaataacgattaggaggatgttctatgaaaaagcttttagctgtagtgttaacatttactatgataacactaatgttcggaagtacgtcaatagttcaagcggaggaaaagtgtccaacctgtgagaaaacagatcctttggtagcacctaccacaaaagatctaaataaaactattgaaatattaaaagacaataatgtgaacacgttagctttggataaagaaaaagctgcagtagtcgaaaatgataaagacaaagctgtaattatcgcagaaaagctatgtgatagtaaagataagattgagtataaccagtattttgttgacgttaataacgaaaaatttgtaactttaaaacaaaaagttgaaaaactagatgataagactgtaaaagctgaagtcataaacgtagaatcaggagcaaaatactctgttacaattgataaagatggaaataaattagatgaaaattttatttcaggaaagtctgctgattttaagcaatcaagtttatgtagtgctatcgtaggtgcagttcttggtacaggatctaaatttgcttgtattgcagcttgtacagctgtaactggaggttggggagcagttgcatgtggtgtattatgtgcagcagtaactggcggaataagctgggctggggcaaaagatatgtgtgaacaattattcggttgaaaaacgacgctcctatataggagcgtttttttatcactagtaatatggggaaattaataaataaactaaaacacccgtaaggctaacatacagccaaattggcattgtccaacgtactatttttcggtgtttttgtgtctgcattgttaaaccccaaattaatgaaaataacgctaacggtacgacaataccagcaagaatactatgagaagttagaataatgtagtaaaagtatttggcgagcccttctcctccataatgagtggtctcttgagataagaagtggtaagttaaatacgaaaataaaaataatattgttgaagaaaatgctgcaagtatgaaagctctgtgaagtttaatgttatgcttttttataaaaattaaagctgctataagaaagatgaacgtaaagctatttagaacagcatttatacgaggaaagatggttatattaaaattcacctcccccttataccctaaaggcgaaaaaaataatagcaagataatcacattagctaaaagtgaaagtgtgattactgtttttgtataatttgagttctccttggacctttgagtctttattctattcaaacttttcacctccctctctaaattaacatgattttttccataatgggccctatatgaaaaaaacaaaacttaattcctattctacacaatatctatttaaggttgtaaaagttattatataagtatgaaaaaatattttaatacagttcatgagatattgccgtttcgctcattttggttattgtgatcgttgcaattaacctgaccgatgaggtatatctgagctgattgcgcatactgtattgatgatagccgttgtttttaccttgttaaaaggaaccattataatgtggagagaatgccgacatgaaagaaaacgaaaaaattaagtttatccagaaagaagttttgactgcagcggaagtgggataactgctcggaatcactcggcacgtttaagctacttttgtgacttcacggaagctcaagcctgttaaaaaaggttgggacagttgcaatgtttttgtttgaacatgtataagcctttaaaaaagaattaaaagccggccggaagaaggccctatgataaatgaagctcctcttatattaaaaggagctttcgtacgtttttatgaaatcctctcatataaatcatcacaacatgtggatatatgggtgcaaaaattaaaaaatggtgagatatctatcaggtgaaaaaaggacataaataggcgcaatgcatggggtggaatgatgtaatctgccctcctaggcccttgatatttagggattcagaagttatttttactctaagaagacttaaaatatcagggattagtgagacctttcatacattcgatgaatgtacgaggggtctctttttattggttatgtgtaattcgtaaaaattacaagacgaattgttgactgggtagttatagaatgatatgatttaaattgcaattagattaagtaattttaaagaaatactttttgaagagggcgggatatgcgacttgaagagattgtaacagttaaaatagggagaaacctctctagaggacatgagaaaaatgatccgacattagttgcttatacatatgaggatttaataaaggatttagatggctcgtttctagactcacaagttagtcctgatgttgaacaatcaaaccataaagaaagctatttgagcagtgtcggggatgttgttttcagctttgtcagttccaaggctgggatcgtgagtgacttaaatcatgggaagatcatcaatcaaaactttgcaaaactcatgattgaacatattgatttggatagtcgatatttatgttatgcattaaatgagtcgcacgcaatgaaaaagcaaatggcaatttccatgcaaggaagcactgtgccaaaattgactcctgcaatattaaaagaattggagatcaaattaccaagtattgagaaacaacggacgattggaaatgcttatttctgtttgagaaagcgtcaagctttggcgaagaaacaagcggaacttgaagagcaactttatttagaagcattgaagagattagaccaacaatagaaaaagtgaggaacacaactatggctgaattacactcaaaattatttagtgccgcagacaacttgcgaagcaaaatggatgcatcagaatataaaaactacttattgggattgatcttttacaaatacttgtctgataagttattagaaaaagtcgttgaaatcgcagatgaatctttagaagaatacaacacacaagaaaaacaaacgcaattgtaccggaatttattagcggatgaagagatcaaaaatgatttgattgaaacgttagtggatactttgggctatgatattgagccagagtatttattcaatgtattagccaatcaagcgaaacaaaacacattccagctgaatgacttaaataaagcatttatcgatttgtctacgaaatatgaccaattcaacggtctttttgatgatgtggatttgacatcgaaaaaactgggatcggatgatcaacagcgaaacatcacgattactgaagtattgaagaaactaaatgatgtcaatgtaatcggtcatgacggagatgtcattggggatgcctatgagtacttaattggtcaatttgcctcagaagctggtaagaaagcgggagaattttacacacctcatcaagtatctgatatgatggcgcgtattgccgcaatcggtcaagaagacaaaaaattatttagcgtatttgaccctaccatgggatcaggttccttgatgttgaatattcgaaactatattaactatcctgaaagtgtaaagtatcatgggcaagaactaaacacaacaacttttaatctagcgaagatgaacttaattttgcatggtgtgaataaagaagatatgcggttacgcaatggggatacattgaacaaagattggccgacagatgagccttatacctttgatgctgttcttatgaatccgccttactctgcaaaatggtccgcagatgctacatttttagatgattcacgtttcaatcgttacgggaagttagcaccaaaatcaaaagccgactttgcttttcttttacatgggttctaccatttgaaagattcgggaacaatggcgatcgtcttaccacatggagttctgttccgtggagcggcggaaggtgtgatccgtaagaaattattggaagatggcagtattgatgccgtgattggtatgccaggtaacttattctttggcacatcgattccaacaacagtcatcatcttgaagaaaaatcgcagtactcgtgatgtgttatttattgatgcaagtaaagagtttataaaaggaaagaaccaaaataaactttctaaagaacatattgataggattgtcgaaacgtatcaaaaacgagaagatgtcgcgaaatatgcccacgttgcaacattcgatgaaatcaaagagaatgatttcaatttgaacatccctcgatacgtcgatacgtttgaagaagaagaacctgtggatatggctgcgattggtgcatccattaaagacattcgaaaagaaaaagaggaactagagacaagcttgtatgacatgatttcttcactacaatatgatgaagaaaatgctgaatggatcaagggtgcgttagaggtgtttaatcgtgggaaataaacgaacaccagagattcgattttcaggatttactggagaatgggaacagcgtcagataggtaatcatgcagaaatattgacaggtggaactccaaagactcaaattaaagaatattgggaaccaagtgaaattccatggatgtcatctggtgaggttaataaaaaacgtctttcatcaacggacaacatgatttcctttctaggattcgaaaattcaagtgctcgttgggtaaaagaaaattctattttaattgcattagctggccaagggaaaactcggggaacagtggctataaatgagataccactaacaacgaatcaatctattgcagcaattgttccgaaggaggaacttcactacgagtttgtgtttcagagtttagaaaaaagatatgaggaattacgattaatttcatctggtgatggaacccgtggaggtcttaacaaacaattagttgctgatgtagtaataatatcaccatcaattgaagaacaaattaaaattggtgatttgttcaaacaactagacgacataatcgcacttcatcagcaagaactaaccaccctcaaacaaacaaaacagggattcttgcaaaaaatgtttccaaaagaaggggagtctgtgccggaggttcgtttcccgggatttactggagagtgggaacagcgtaagtttaaagactttatttcgaaggctggtaagaaaaatacaatgggtgaaaattatccagcatattctgtaagtaataaagtgggactagttagccaatcagaacaatttgatgggagtcgattagataatcttgataaaacatcttataagctagttaatcctaatgaattcgcatacaatccagctagaataaatgttggttccatagcattcaatgacctcaataaaacagtaattgtgagctcactttatgtaatattaaaaatgagtgaggaattggataatgagtttattttacaatttattaaatcgcaattttttattgatgaggtaagaaaaaatacggaaggaagcgtaagagagtatttattctttgaaaattttaaaaatattaagttcccttacacttctagcaaagatgagcaaaccaaaatcggcaccttcttcaaacaactagacgacacgatcgcccttcaccaacgcgaattagatgccttacaagaaacgaaaaaagctttcctacaaaagatgtttgtttaacgaataaagggggggagaaacatgacaacgatccagcataaagatgaagcagaggtagagcgccgcctgattgaagtgttaggcgaagggtataatcagtggaattatcgtcctgatttaaaatcggaagctgacttgtgggagaacttgcggcaaaagattacacaaaataacttatcagaaattggggaacatccaatgactgataaagaattcgattcgataaagacagagttgttatcgaaaacacagacaccctttgatgctgctaaatggctcaaaggggaaaatggaattgctcggattacgattgaacgtgaagacgtttcattgggttccatgtcattggtgctgtattccaatcaagatattgggggcggcatttctacatacgaagtcgttcatcagattgcgaaacaaaagagtcacgttgatggtcgtgaccgccgatttgacgtgacacttctcattaatggattgcccattgttcaaattgagttaaaacaggccagtgcaaaagacggtgtattccaagcctatcatcaaattaagaaatacgcagaagaaggaatgtttcgaaacaatatcttttctaccttgcagttatttgtcatttctaacgaacaaacaactcgttattttgccaacgctttgccaaaagatatccataagaaattcatctttagctggcggacaacggataatcgaaaagtagaaaatctctatgagtttgtgaaacaagtgttaaacattccagatgcacaccgtttgattgccaattatacaattgtgagtgaagaccaagacaacaaagctctagtggtgttaaaaccgtatcaaattcatgccatagaagccttgtttacatccgccatgaggcatcaatccggctttgtttggcatgcgaccggatcaggaaaaacgttgacaagttttgtgtctaccaagttattggctcgcaaagcaggtgtagaccgtacgattatgctgattgaccgaaaagacttagataaccaaacaacgacagaattcactaaatttgcttccgagtttaataccggtatttcttctggtgatgcaatatcgaatagcttgattgtcggaactggaagtgcgaaggagttaagtgatactctactgtctgatgccaattccaatacagtgattattaccactcgtcaaaaactagaagctgccttgcgctatgcccaaaggcaagaggagcaaaaaggtactcagcgctttaagaaactgctgggacaacatattgtctttgtcgtggatgaatgccatcgtgcgttaagtgcagaaggcatggaagtcattaaggggttctttccaaattcgacttggtttggatttacagggacaccgatatttaatgaaaataaaaaacaagcgaagggccgattagctcgcactactcgtgatcaatatggagacgttttgcacacctataccattaagaatgcgttagacgatggtgctgttttagggtttcaagtagagcatgaagatacaattgaccccacttcattaaataatcatattttcgaacagctgcgtcatcaagaaaaatacgccaattgtagtgatgatgaaatcaacgatatgattgatcgaatggatggaatcgaaaaagaagcataccttgaaccatcttcgttcgagaatgatgaacatattcaaaaagtcattcataagatttttaggccggataatgcctatattaaatttgattttcaaaacggccgcccgcaaaaatcagctattttaacaacaagttccattgatatggcgaaacgttactatcaggcaattaaagaaatgacgaaagatccagattggttaacaaaagagtttgcgggacacccgatccgaacagggcgtacaattgaggatcctgattttcctcggattgcaattacgtattcaatgcaagaaaacgaggaagattccaagcaaactcaagatgaaatgatggagattattaaggattataacggttactatcacactgcttggtcgatagaagatattgaacgatataatggtgatattaacaatcggttagctcgtaaaaaaggggaatttaaagaatttgggaaacaaattgaccttgtcattgttgtcgatcggttattgactggttttgatgccccaacgattcaaacgttatttgtggatcggaatttaagttatgccaatttgattcaagccttttccaggaccaatcgtacgtatccaggaaagacaaaaggattaattgtcacattccgtaaaccttttacaatggaacaaaacgtaaagaatgcgacgaagttatattctcatgcacaagaggaatctagtcttgtttatccaacgtatgatgaatcgaagaaacgttttaagaaggctcacaaagcgctaactacattaattcccaatccaaccgatattgatgagaacacatctcttgaaacccgaattgagttcgtgaaagcatttcaagagctaaacaattcttacgaagcgttagtgacatatgatgactacaacgatgatatggaaaaatcagcagcacttcaagaacaggtggaaacactagaagaatatattggtatctatcacacgattaaaggttcacttatagatgaagaggaccaagatggagcggaaccggatttttcagacattgagttttatggagaaaatgcagtgaagatctatgatattgattcaacgtatattgatcgactattagaaacatactcggccaataaccagaatatccgtgatgagatcgaaagcgcacttcaaaaacttgagaaatcagacattgttaaagatgtataccgtgagatgttaaatgccattgatacgaaaaaagtagatgaagaggaagatattcttgtagtgaaaagacgcttcttcacgaaagaacgcagccaagcagttagggaatttgcgaatacttggtttgtggcagaggatgaactgtatttatctgcagttcaatatgtgataggagcagatcctattccgaatatcgggggaattatcaatagcaagcaatttgatcagtataaagccgtacacccagatgcaaaaccgttgaaatacggaccagagttgaagcgtcagtggagaaagatgttagatgaagtcattgtacctttggatggcgagctgagataaagacattttgaattaaaggaatctatataacgaaaggccaactgcgacttgagttggcctattctgtttattattaaagaaacagtgtaagattgctgacagaactactatgcgtattagtcgttttctttagtcacccttgccaatcgctccacctctccccgaatcccaatcgcaggctcccaagaatcaattaaacgaatcgctttttgattgaattccatcgctttcgttttctctcctttactgtacaacaactgtgccatcccataataataatagatcagctcaacctgattcgcgttatgtttgtcatagagcatttgctcaaaggcttcttccgctttctcaaactggtcacacttcacataagcaacacccaaattgaaataggcttctatcgttttttcgccgccgtacgtggagctgatctcatttgccgcttcgtatagttgaatggcttcttcatcaaggtctctcgcaaagcttaggtctccgcgaaccaatagaaccctgtgttgaatcgtaggggaaatcggttgatcttcgattttgtttaaaatggtcattgctttttcctgttgcccggcttttaaaaacagccttgctttgagtgcatgtccccaaacctttagatcataggcatcgtgagcgtctgattgttccagaatcctcagcccggcttcaatttgctgtaaggccctgtctaaatcattgacttccatcagagcccagcctgctgtgtcgattcggaagaacgcttctcgtgtgtgttggcctaattgatgggcggcgtcggcggctttgcgcccgtattcgattcgcaggggcaggttgattctgcttagaaaatggctgatgcgggtgatgagttcgattaggatttctttttgatcggtttcacttgcccattggatgacctttaagatgtttggccattcttgtttcatttgatctaagttccgtcccagcaggtagctccaatagatagagttgggctgttcccgctttaaatgggtttcggcataatcaatataatagtgagcccagcgattgcgggcttctttttcatattcgtgctgttcggacaagtgctgttctccgtaagcgacaacggtttggtgcgctaagtattgtgtcctgccttggcttcgttccggctgaatcagcgcatatgaccgcatttgctccatagcgtaatgaaaacggcgggcgtctaatccggctgctgccgccaggcttttttcatcaggcggcttgctgaaaaagcaaagcgtctgccatagctttcgcgtatcttcattgcatctatcccaagtgcggccaaagaggaattcaaacaattccagcagtgagtagcctgcttttccaagctcatgaatcagctgctgagcggggatgtcatcgtctgacatataggcaatgctgagtgccatggctttcgggtttccggcagtcgctgaaatgaattcgtttttcaggtcagatgatagatgtaacagctgctccagcttttcccgtttattttgaatgttgcatgtttgtaagcatcggtgcacttcttgctgaaaaaaatccaaggcatctgtttgctcaaggccgctcagctgaatagctgtcatttctccgaagctttcccgataggtttgctttacgttttcccgcgctgtgaggagaactttcacgccttgcggaaggctggtgataaattcatgaatgtcacgttctgcagtatcaatgctgtcaacgatcagcaggatcggtttttctctagtgtaattagctaacgcattgcggacgacgaatcgtttttcattgattgatttatcgatttgttctgtgcgtccgagctgataggcgatcgtatttaaaaaatcgctaaagctcaatcctttccaatcagcgctgacccaaatgatactgttgaacgtcggccaatctgaagtatcgccgacacaggaataggcggcttcaagagcgattgtggttttacccataccagcccagccggtgattaaacagactggtgacggagaaagcatccattgccgtatcgcttccatatcaaagctgcgtccgataaagcgtccggaccagcgtgagggtaaattatgcgtgataggctgttctgtaagcgcattcgtttcatggccgggtctgtcatgaaacagccgttttactacattttcaatttcgtcttcactcggagccccaaataatccgtcttttcgcagtattttcgcttttttcaaacaagatgctgcccatacaggcaatgcgggtttgatgactgggatagtggtggcttccagcaagtcggtcaaccaatcgatatcgaagtcggtcttttcgagaatgatccagatcattccgaacagttttccgtcgtcaattcttccgggaatgtagtttgcccccatctgtccgatccagcttttgatcgtgtttggggagactcccagctggagtgcgattttatctatgtaagactgtcctgttttttcattctttttccttctgactttataatcaggatgaagttttagcgttttgacgccaggtgccagcagttgtgcaaattgttttcggttttcaagttcagccataagcctgcacctcctattagtactattttatcaatccagcgttttttgtatatgaaaaaataaaagtacagtgccgctgtccttttatacagcagaaaaggctgttgaacgtcttgaaaagcagataaaatgggggcagtaacagagaaaataaaaatgtatgcacttacattttattttctaaagaaaggaatttgccaaatgactcacacagtacctcagaacatgaaagcggctgttatgcacaatacaagagaaatcaaaatcgaaacagtgcctgtgcctgacatcaatcatgatgaagtgttgattaaggtgatggctgtcggaatttgcggatcagatctgcattactatacaaatggccgaataggcaactatgtagtggaaaaaccatttatccttgggcatgaatgtgcgggagagattgccgctgtcggatcagctgtcgatcaatttaaagtgggagaccgcgtcgctgtagagccgggtgttacgtgcggacgctgtgaggcgtgcaaagaaggacgctataatctttgcccggatgtacagtttttggctacaccgccggtagacggtgcgtttgtccaatatattaaaatgcgtcaggactttgtttttttaatcccagactcactttcttatgaagatgctgctttgatcgagccgttttctgtcggcatccatgcggcggccagaacgaagctacagcccggatcaacgattgcgattatggggatgggccctgttgggttaatggctgttgccgcagctaaagcatttggggcaggcacaatcattgtcaccgacttagagccgctgcggttagaagctgcgaaaaaaatgggagcgactcacattattaatatacgtgaacaggatgcacttgaagagattaaaacgatcacgaatgatagaggcgttgatgttgcttgggaaacagcagggaatccagcggcattgcaatccgcactggcttctgtgcgccggggcggaaaattggcgattgtcggtttgccttcacagaacgagattccgctcaacgtgccgtttattgcggataatgagattgatatttacgggatcttccgttatgccaatacgtatccaaagggaatcgaatttcttgcttcaggcattgtggacacgaagcatctagtaacggaccaatattcgctggagcagacgcaagatgcgatggagcgggcgcttcaatttaagaatgaatgtttaaaagtgatggtgtatccaaatcgctgagtgaacagggaggatcttcgtattctccctcttgtttactggaaatgaaaacggattcttggggtgggaaatgatgattgaaacagaaaaagtaacggcaatgaaagtgaagcatcagtcaaaatccagtaccggactgtcctggtttgaacgaatcggttatggattcggcgatatgtcgtataatattatctttcagtttgtaaacgcatacttattattttattatacagacgttggcggcattcagcctgcggtgatcgcaactttgtttcttgttgtgcgtgtgctggatgctatttttgacccgatcatgggattgattttagataaaacaaatacaaggtggggaaaagcaaggccatatttgctgtgggtggcatttccttttgcgctattcacattcttatgtttcacgacgcctcatttcggtgagaccggaaatatggtatatgcgtatgtcacctatattctgcttgggatgtcctttagtatgcaaacgatcccggtgaacagcttaacggggcggatgacgaattctgtggaggaacgaacggttctgaccacaacccggatgattttggtgtatatcggcattcttttatccatttcctgtgcgacaccgcttgcaactgctatcggaggagaggatcaggcgtttggatttcagatgacggcgctcatctacgcggcggtcagcattgttttgaatctattcagtttctttactgtcagggagcggattcagcctaaaaagagaaaaaaacaagggatcaaaaagacgttatccgttttattccaaaacaaacccttgctcatgttaatttcatcatttttggcttttgcgatcgggtttaatattaagctcagcacgatggtgtattattttacgtataacgtaaaccataaagagttcgtgtttatgggcaccgttttatttttcggggcagcgctgatcagcaatttgtttattcctttcttttctgagaagtggggcagaaaacaagtcatgattatcacggcagctctatcgcttatttcttatgcaggcctgcattttacgccgtattcttcaattccactcattttcatttggcttttcgcttcgggatttttcacaacgcctttaaatacgcttgcttggggaatggttgcggattgtgtcgattatgcggaatggaaaaccggaattcgcgcggatggtgtggtgatttcgagcatgagctttattaataagctgggtgttgcgttagccgggtcattttcggccatttacttaggaatcgccgggtatgtggcgaatacagaccagacagttgggtcgttgaatgcgattaaaaatatgaatgctttgattccgggatttttcattttgctttctattattcttattgccttctatcctttaacggaaaaaagatataaacacatcatctctgagctggagcaaaggtctgcgagataaatatatgtaaaatttttaatattcaatgttgtatttatggcagaaagtaatatactgagactgtaatctagactttataaatgagtgtgataatatgcgtagtcattctgtagtttgtattggggaattgttgattgatttcttttgtaccgatgttgacgttgatttaatggaagggcgccaattcctgaaaagtgccggcggggcaccggcgaatgtgtcagcagcgattgccaagctgggcggagacgccgctttcagcggaaaagtaggaaaggatccgtttgggtattttctgaagcgaacattggacgctgtacatgtcgatacctctatgctggtgatggatgagaaagcgcctacaacgcttgcttttgtttcattaaaacaaaatggagagcgtgactttgtttttaatagaggcgcggacgctttgtttacgctggaggatattgaccaggaaaaactaaacgaagcgaaaatccttcatttcggctctgcgacggcactgttatcagatccattttgctcagcctatttacggctgatgtcgattgcgaaagacaatggacagtttatttcgtttgaccctaactaccgtgaagatttatggaggggaagagtctcagagtttgtaagtgttgcgaaaaaagcgatcgctgtaagtgattttgtgaaagtcagtgacgaggaacttgagattatcagcggtgtgaaggatcatgaaaagggtgttgcgatccttcatgagatcggagccaacattgtcgctgtgacacttgggaaaagcggaacgcttctttccaatggaaaagaccgtgaaatcattccaagcattccggtgacatcaattgactcaacaggggcgggagatgcttttgtcggtgcggctttatatcaattggcaaacacggatcagattcaatctgtagatgctgattttgtgaaactgcgtgagattgtggcgtttgccaataaggtcggagctcttgtgtgcactaaaattggagcgattgatgcactgccgagcttggatgagatcgaagtttctttgtaaatcattgaagatgtttcttgaaagtctttggacttttgggggcatctttttttattgcttacatttttgttcaggtaaaaagttgtatattttttgtttgaaatgtcattttttattaaaaaagtgaaacttttaacgataataaatagtatatgtaacaagggttaccgaattagctttaggaggaacgatataatgagtataattggaagatttaaagatattatgtctgcgaatatcaatgctttattggacaaggctgaaaatccggagaaaatggtagatcaatatttaagaaatatgaatagcgatttggctaaggttaaggcagaaacagcagctgttatggccgaggagcagagagcaaaaagagaatatcacgaatgccaggcggatatggaaaagatggaaagctatgcaatgaaggcgctgcaagccgggaatgagagcgatgcgagaaaatttcttgaaagaaaaacatctttggagtcaaagctttctgagctgcaggcggcgaatcaaattgctgcaaccaatgccgcacagatgagaaagatgcatgacaaattggtatctgacattggagagctggaagcacgtaaaaatatgatcaaggcgaagtgggcagtagcgaaaacgcaagaaagaatgaacaaactgggcgcttctgtttcaagtacaagccaatcaatgtctgcattcggccgaatggaggacaaagtaaataaggcacttgatcaggccaatgcaatggctgaactgaacagcgctccgcaggatgatatggctgatctgactgcaaagtatgacactggcggttcaagccaggttgatgatgaacttgcggcgttaaaagcgaaaatgatgctcgataagtaatacataggaggccgcagctctcggctgcggcgtcattttatcataagatgtgagagggaacggtaatgataatatcttataagtgtccgaactgcggcagtgatatggcatttgatagtgaaaccggctcgttatcctgcagcagctgcggaagacaggacaatattgaaagccttccgaaagaaaacattgcggcacggttttctgatgatgaagcaaaagaatatcaatgtgaaaactgcggtgccattttgatcacggaagctgaaacgacagcaacgacgtgcagcttctgcgggggtgctgcaatacttgcagatcgtttatcgggacatttggcaccggcgaaagtcatcccatttacaatcagcaagcaagaagccgagcaggcatttcgaaagtggtgcaaaaaaggccttctgacaccaagaggtttcatgtctgccgatcgcattaaaagcatcaccggcatgtatattccgttttggatgtttgatttaaatagtgaagtacaggtgagagcaaactgtaccagagtccatcaatatgaagaaggggattatatttgcacggaaacagagcactttgaagcgtttcgtgatatcaatctcgattatttgaaaatccctgtcgatgcctctgaaaaaatgaaagacgaattaatggacaaattggagccttattcatacgaagagctgaaggactttcaaacggcatatttggccggttatattgcggaaaagtacaattataccgatgaggagctttttccaagggcaaaagagaaaataagcagttatatagattcatacatccattctactttttccggatatacgtcagtcaatgtgagggacaaacatattcacacgaaaaacgtgaacagcttttacgttttgcttcccgtttggatggtcagttacgattatgaaagagcggagcatatctttgcgatgaacgggcaaacaggaaaggttgttggaaagccgccgatcagtcgaggaaaagtggcggcatggtttagcggaatagcaggcgggacatttcttgcgttgaagctcgtctcattgatgatgggaggcggattttgatgcggggatttttagggaaagcgatctttggtgtgctggctgtcttcatcatgatgcctttactgggtatcgaagcggcaagagcctctgaatcgcagcagcatgtgtacgatcgcgctcatctattgtcaaaagcggagatcggaaaacttgaatctctctcggcagagctgggtgcaaagagggacactgatttcatcattattacgaccaaaagcacaaacggtgaagatattgctgactataccggcgatttttatgatcgttacggaaaaggcagtacagccattctgaccattgatatgacaaacagagaagtgtttatcgcaggcttcaaaaaagccgaacagtatttggacaacagcaggctcaatagcatcagaaatacgatttcatctgatttatccaatgaaaattattttaaagcttttgagacatatattcagctttcctataaagatatgggcataaaaccgggagtaaaccccgacaacatattctttacatggtggtttcagctgattgctgccatcgcagtcggggaattgcggtttcaatcatgctttatcatgcaggcggcaaagtaacggttaatggaaatacatatatggatcagcgtacgtctgatgtgattgatcaatacgacacttatattagaacgactgtaacaagagaaagaaaaccatcagataaagacagcggcagcgatggcggtgttacgaaaggcggtacgtcatacagtgggagccggggcagtttttaaatgtaagaaatagagaaagggagaggcgtaatgtcgtttttcagaaatcaattagcgaatgtagtagagtgggaagaatttagagatgatatgattttttataaatggaacaatcgtgaaatcaaaaaagggagccgtttaatcattcgtcccggacaggatgctgtctttttgaacaatgggcgggttgaaggagtctttcaagatgatggcgattatgatattgaatcagaaattattccattcctttcaacgttaaagggctttaagtttggctttaacagcggcatgcgagctgaggtgctgtttgtcaatacgaaggaatttaccgtaagatggggaacaaaacaggcgataaatattccggcagcgggaatgccaggcgggatgcccattcgcgcaaacggcacatttaatttcaaggtgcaggactatatcagcctgattgataaaatcgctggcgtgaaagatcaatattttgtagaggatattaaaacccgtatcatttctattctggatcagcttctcatgaagtggatcacaagagaagggaaagatatgtttaatcttcaagcaaacgcttttgatattgccaagggaattcaagaggacttagatatgcaattaataagcgacgggatgacggtcactggttttcaaatcatgagctttaattatcctcaagaggttcaagatatgattacaaagaacgcttcctacggtatggttggggatgtgaacagataccagcaaatatcaatgacggatggaatggcatccggaaagatgagcggaggcggagcggcttcggatatggctggaatgatgatgggaatgaatatggccaatcagatgatgaaccaaatgaatcaaaatcagcaggcacagtcatcaggcccacagtcaactggcagcggaagcaaaccgaatttctgtccaaactgcggaacaaaaacgggcgaagccaatttttgtccgaattgcggccagaagcttgtgtaagactcatacagtgaaaagtccggagtgatcagcgctcgggacttttttatttagaagaataagcgttaccgttacctattgcttgctcctgaacaggccattttcgagcccccgcttggataattcccagcagcaattgacgacgttcctttattgaattgacggcaatttgaaatgtttgctttgataaagccggtatgcctgattgttgaagctttgagatgtctggttccggcggcgcttgttctgcaggatggatataggcagtatgaacggtatctagatagtttttgatacttgagcgcgcttctttgatatgaagctgattcggctgatattgttcaggaattccgtatttgaaaatggttagagcctcatccaatacagcaacagctataatggatgattcctgatgctgcgtgctgtggtaaaaatgaaggatggggaaggcgttatgctgagcggtcagctttcccagttctgatgaggcagcgataagaagaaaatcaatgtcgtgaaaatctttgccattccatgcattatggacgatttctgttccgtcatgccctagacttaatacactttgggcaaaggagcgtttttgattaaccgcactcaagacggaaatcaaatacgtgacagaaaacgtgatggtaagcagtccttgagctgtttcaataatcgtgacaagcttccataggcctccgttcggagcgaggtcgccatttcctaatgtaaacatgacatagccggaaaaataaattcggtctgaccaggaagccggttcttttgattgagtttccataagtgagtgagggtcactcgagtaaatcaaaacccacccgctccaaaatagactgatccatatcactaacgtcaggcataacagcagaggaccagccatacttagaacctttgcgtggtcaccgctgattttgcggcagcccttccacagccaggcagacaggcatcttgtgatcgggccggcaccgctctctaaccataacgtggtccataaaaaatcaatcatccccgctgtcaataataaaaggcctgcaatgatataaccctcattcattttggttgcctcccttaagtcagccttcatttattttcttctctatttccttttatcctgagtctgaaacaattgaacgaatgtttgattttacagagaaaaatgggtgaagttacccaacacttactcatttatcgatatgaatagaaaatcacaggatttttgacttgattcacacattttcatgaagaaaaacgttcattttccccttgaattggtgattttccttttatagagtaaaaaattttcagaaatttatattgactgaaagcatttttataattatgataatatcagatgtaacaaaaatatcactatcatatcactacaattgaactatcaagtgactattaaatgccaaatttacaaggttatgcacaaagaaatgaccattgttcttttagtgagaaatgaaatcgcttccatcaggactgacatgctaagaagaagggaaggttatgaggttgttatgaggttattggataaaaacatgaacaactattttctgaagcctgcttacgaaatgtgaggaaggcagcagccctggaatgagtttttgacatacgcattttgaaaaagactgggggaaacagtatgaataaacaaggcaatcaaatgtcatttttacgtacaattattttagtctccactttcggcgggcttctttttggctatgataccggtgtgcttaatggagctttgccgtatatgggagagccggatcagcttaatctcaatgccttcacagagggtcttgtcaccagttcacttctttttggagcggcactgggtgctgtgtttggcggcaggatgtctgattttaacggccgccgcaaaaatattttgttcctcgctgttatattttttatttcaacgatcgggtgtacgtttgcaccaaatgttacggtcatgattatttcccgttttgtgctcggtattgcggttgggggtgcatccgtaacggtgcctgcctatttagcagagatgtctcctgtggaaagcaggggacggatggtgacgcagaacgaattgatgattgtatcaggacagcttttggcctttgtttttaatgcgatccttggaacaacaatgggagacaactcccatgtgtggaggtttatgctggtcattgcgtcacttccagccttgttcctgtttttcggcatgatcagaatgcccgagagtccccgctggcttgtttctaaaggaagaaaagaagatgctttacgtgtattgaaaaaaatcagggatgaaaaacgggcagcagctgagctgcaagaaattgaattcgctttcaaaaaagaagatcagcttgaaaaagcgacgtttaaagatctttcagtcccatgggtgcggcgtattgtgtttattggattagggattgcgattgtacagcaaattacaggtgtgaattcgattatgtattatgggactgaaattctaagaaattctggtttccaaacggaagccgctttaatcggaaatattgcgaatggtgtgatttcggtattggcaacattcgtcggaatctggctgctgggaagagtggggcgccggccgatgctgatgacaggcttgatcggtacgacaacagcgttattgctaatcgggatattctcacttgtacttgaaggatcaccggcacttccgtatgtagtcctgtcattaacggtcacatttcttgcttttcagcagggcgccatttcaccagtgacttggctgatgctatctgaaattttcccgcttcgccttcgcggactgggaatgggtgttacggtattctgtctgtggatggtgaattttgcagtcagtttcacgtttccaatattgctggcagccatcgggctgtccacaacgttctttatcttcgttggattaggaatttgctctgtcttgtttgtgaagaggtttttgccggaaacgaaagggctttcgcttgagcagctggaggaaaacttccgggcttatgatcacggcggggcaaagaaggattctgggactgaagtgattggataattaaaaaaagaatccgcacctgagtgcggattctttttggtttcaaattagttaggtctgacaaggattttgacttggcttttctctttaataagagccccgaagccttcctcgatcaaatcatctagtacgatttttttcgttacgagtttgtcggctgagaaatagccttctttcattaatgacagtacagccgggaagatgtcgcggtatccgataattccttttactgaacgttctttgatcacgatatcgttcggatggatttcagcacctttttcccaaatactgacgatgacggtttcaccggcaattgtagtggactggatggcttgtcgtaacaccactgggacaccagtgacttcgaatgctacgtcaacaccgcctcctgtacgttctgcaatctcagcgactacatcgtctgttttagacggatcaacgatgatcgcgccaagctcctcagctttttgctggcgttcaggagaaagctcaacagcgtaaatatcggttgcaccggcagccttcagcgcttcaatgacaagaagaccgatcgggccgcagccgaatacagccgctttgtcgcctgctttgagtttgcttgagcggacagcgtatagagcaactgcagaaggttcaacgagtgcgccttgttcatatgataattcatcaggaagtttgaacaaaagctcttcatctacagagacgtattcagagaaaccgccgcctccgccggctaagccgaggaatcccatttgttcatcaaggttgtaggcgccttggtggccgtgtgtagcaaaaatcggctcgactacgacgcggtctccaactttataattttcaacgccttctccgacttcgacaacttcaccggagaattcatgccccattgtgacaggtgccgtttcatttgttaatgggtgcggtttgtcaaccggaataaagatcgggccgcccagatattcgtgtaaatcacttccgcagatgccgcaccatttgactttgatctttacttttcccggctccgtttttggctcttcgatatgttcaatacggatatccttttggttatgccatcttgctgccttcatggattaccactcctataacttttgatgtgagtaattccgcaccggtcaatatgaactgttcacaaaatcgccatttttaaaaccaaaaaagaaatgaaatttttatataatataatctacgtttttttgaaaaaagaaactttgaagaaaaaagggtctcgcacactcttttttctttatatgagagtatcaatcgtttacatagctatgaatttggtttgaacaatacggtaatggttcgttcatattgaatgcgacaactactctatcaataattataacgctaatactgctattataataggataatcttccatggtttattttagcagaggtaacttttttgactttgtaacattactgtaaggatattgaaataaaaaatagctggttgatcgtgtataatcttcctagatgttaacaaacagggggacgaaatgttgaagaaagtcattttagccgcttttatcttagtaggaagtactttgggagcttttagtttttcatcagatgccagtgcgaaacatgtgaacggaaatattacttggtataatggagtcgggaaaaaaggctcttcaggtaagaaacttggacattgggattgtgcgaccaaaatcggatttgatgttcctagaaacgggacaaaaatcagagcttatgcaaaagcgaagcctaaaaaggtgattacggtttataaaaatgatgttggcagaatgcctaatgcagtgctggatgttagccctaaagcgtttaaagcgcttggatatccattaagcaaaggtaaagtagctgggcattacagctattaatgtacatatataatctggaaagcaagaagtcacattcttgctttttctattggtggagataaaagatgaaaaaaagaatcatattattgttagcagtgataatagcggcagctgccgcgggggttgcgttttatgttacaaaggataaaggccatgagaaggctgctgatgtttcagtcaataccgaaagcggtgatgagctgctggtttcaattacagatacggatctgctgacaaagtattatgaaaatgacaaggtgatccatgaggagaagctgaccagctatccggcatttgccttggatcaaaaacagcaggtgctctattatacgggcaataatgaacagaatgaaatgaggctttttaaattggatctgaagtctcataaaaaaacgatgctttataaaggcgcggagagtgcggacagtttatttttatcaaaggaccgttcaaccatctatttccgcttaggaaaagcggacgaaagcaattttcggatcgccgcttttgatctgaagacgaaaaagtataaaaatctttatcctgccgctaatgatcaggatgacaccgtcagcagcttcttttataaccaaaaaaacgattcatttgcattgcttcattattctgtagaagaagactacaagaaaacagatgaagcaaacgaaaagggcatcgacccagaaccgacaacgattcattttgcggaaggccgccaacataaatttaatgagctgaaaagcctaaaccaatttatcagcgatattgctgtttctgatgatgataaacgtattttattcacatcatatacgcaaaaaggaacggagcaaaccgcttctattcaaatgctcaatgcggatacgaaaaaatatgaaagcatcatctcaaatcaaaaatcatttaagctgttaattgacgcacagcctcagttctctaaggatggaaagaacatttattttcttgccgaagccaagggggctaaaaaactgaaggatgaaacagggcgtgaagctaaggtgcggacgatttattcctatagccttgaaaataagaccttcaaaaaagtatggaaaaatccgaacggcatcatcaacagcttttctgtgattaactaataaaaaccactcggcataagctgagtggcttttttaatggatgaggtgcagggctaatgatccgagccatttaaagatatgaatcagaggtaccgacaaaaacagaagttcaacatacgagttcattgcaacattcagctttttgaacgcagctctttttttcaagtctttttgctgctggtttgagatcacgttatcactcctcttatatccatattataccattaaaacagacaaaaaagccctaaacgtttacagttttgggcttctttcttcgtatttggcctcttgcaatgagaggcttttattctgaaatatagaattttgtctccgttcggggtttgtttgcttgcaggagactgcatttgttatagggaagaactagcttgttttcgtttggctgttgttttggagattcactaatgaacggatgccgtcgaccattttacttccgcacaaagggcacaatggcgtatcactgctggcgaagttttttcgggtccagccattacagtcttcttttgtgcattcccaagtactcacatcttcttttggcagcggttcttgatttcgtttgttatagtaagacataaagtcacttcttccctcatgtattttactgcacatttcttattgtctcatacttttccctaatctcctaattcctttttctttatgactttccaataaccccatctaaaaaggagaggagtgtgctgttaaaagcatctggctcttctaaaaacgggcaatggctgcttttagaaaaggtaacgagtgtcgcgtttggaatattgctgcgcaagtgttctccagctgctgtagagaaaaatttcttgtcttccccgaagcacagcaatgtcggcacattgatgttttggagggtgctccggtaatcagcggccgtttggttaaataaaatcgtgctagaaatggcagccggctgtttgaggatttctgccagcatccattctgtttcggtctcggcaggcggttctgcgaacatattctggatgaagctttcgtagaaaggcagcgggtcagtttgaatggcgtgcatcgctgtttttaagccgttaaaatcaaatggaccgtgttcccagccctcccattgatagtcggaagcggattgatcgatgatcacagcggcttgaatgttatcattcccaaattgattgagataatcccatacgacaaaagcgcccattgaccagctggcaagaacgacatgatcaagctccattacatttagaaattcccttatgtcacgggcatattgggaaatggtgtggccgtgaagcactttgtcagattcgccgtgtcctctaagatcaagacgaatacattgataattggcagaaagcgccgaaaattgtttgtggaaaaattgtccgctcatcagcaccccatgtataaacaggatcggcgtcccgctcccgtgtgtttcatagtaaaggcgtgtctgatcttctaatgtgatgtatggcatgtttctcctcctttagtttccatcatgagtatggctggctgctgttgagctgatgatggcagctgtcgcggctgcctgctgcgcttgaatgactgtttcgatagaggtgtatagtcctgattccatcagcagatttttctccatatgctcactgagatagaggctgacagcaattttaaaattcatttccttttgccgtttaaaagctttttcctggtttaattcgtcagtgatgcacaaaacggttttgatatctggctcttccagaaatgtgaggagagcaaggtctggataatgataatcctttggttttttgacagattcagtgatcgattgatatatctgtttgcaagcggaaacaagcatttcgggctctttttcactttgcaaggccagaatatggctgacctgatgtaagtactgtccttttttaaagccgttggctgccagcagctgatagcatgtttccgccttctgtagcgcctgcaaaccttctccgttttctccaagcagtacggcaagcggaacattctgagttgaagtgaggaaataatgatttttcttcatctgctgataaactgctagccccatgttcatctgttctttttggtttgtcgtttcagatttgccggtgagcaagattagagcggaaaggtatgtgaacatatcccgcttgtatcctagcttcaccatttcattgtatacatcgataaaagtatgaaatgtttgttttgcctcatgctgaaaatgaatgtccagaatagatgcaatagtaaagcggtggtgtgaattgagtgttgagaagctgccgatgtttgatttgatatagctgctcaaatcataaaagcgctgaaaatcaaactctcttttattcacaatatatgcagaagaaatgagcattaatatctgatcgtgtgaaactttccattttaattttggttttaattcagcataaatggaaatgtattgctttattttttcatgtaggttgtgtgtcagcataaaaagcagctcctttttgctgtttttacgtaatacgataaatagggccaaaggtttcataaagaaaaaacttgcctgctagaggcaagtttgtcgggttatttatggggatctgttatatccatcggtctcatcatgtcatagtcttcatgctccagaatatggcaatgccatacgtatcgtccgctgtacggaccgaatgtcgccgcgattctcaggacttcacctgcatgcgcttgaatggtgtctttccagcccttttcacttggcggcggcgggacagccggaccggtataggacaattccccgctttcttgataacgggcgatatcaaacggccgccggtctaatacacggaaggagactagatgcaggtgaatcggatgtgttccgcgtgttgggttgataatggaccatatttcagttgtgccgacttttggtgcttctgtgacgggatcgtgccagcgtttgttattaagcagaaggacgggtctgccgtattcgtcctgggtgcctgccagttttaacgttctgatgttttgtattctttcatgctgtaccgaagggtatgaggcgaggtacttcggctttctgctttcgtctttttgtgccaatggttttgtgactctgaattgcatgatattcgcatctgtttcaggattgacgtcaccgccgcagcccgcgctgtttgccaaaatgatcgattctccttcatacgctgtgaagtcaatgatgatatcataacgttcagcaggcgcaaggctgaaagaattcagtttaacagatcgcggcaggagccctccatctgaaccaatctgaataaactctccgccattatcgagtgacaggttataggttcttgtattggaggcgttgatgacacggaatcggtatttccttggctcgacttccaagtatggccataccttcccgttgacgagtatggtttctccgcaaaaagccggaacgattgagggattaggcagtgacggagaagggttttccggtgcgctcggataaaacaaagaaccgtcctcattgatcgtgcggtctgtgataagaagcggcacatcgtattcgtctgaaggcagttttaagcgtttttcctttgggtcatgaatgatataagcaccgacaagtccggcatagacatttagcctggtgagcgccatggcgtgatcgtgataccacaatatagccccgcgctgctggtttggataatgataaacctctcttttgaaataaggtcctgtttgttcaaagtctttggaaaaccaagcctcgggatacccgtcactgtcatctggcgtgacaccgccgtgtaaatgaacaacagtctttacctcgggctcttcatgctggctgtcactgtgatgaatggtgtgatcaatcggaaggaaatgcgtggaaggtaggttattcatccattttacatatacgttttcatttcttttaacctcaatggtcggccccggaaataagccgttgtagccccacaggcgggttgggggagatcgcgatggagctgatgggtgcattcctccatggtgacttcgtagtatgttttttcttttgattgctgtactggctttagtgtatctgggattgggagagcatccacaaatttttcaagtgtcattttcatctgtccttatctaaattttccaaattggtattatagttaatgacaataaggacgtgatggttacaaaaaatcttcgtgctgcagactgcccgagaaagaaaataacaaaatcctaaacggctggccgtttaggatttgatcagcattaaggcaggatatcgggctgctgctgtgtgactgggttggcagccgctttctcgctcaccttgcgttttctgaacacaaggtaagaaatcagaacgattcccgtgatgacgcctgtaagcagcagctcgtctctcatggaatcaataaacgccatggacactaaaattccgcaaatggcgatgatggtcaagtaggttaggaaagggaagagccacattttgatcttcaatgcttctgggtttgttttttcgagttttttccgcattttcagctgggaaacagcgatgacaagatagacgagtaaagcgattgcgcctgatgagttgactaagaataaaaagacggtatccggtgaaaaatagttcattacgaccgcgatataagagaaaaatgtcccggccacaatggcttgtacgggaacgccttttttgctcaatttcataaaacggcgcggcgcttcgtttctttctgcaagagaatacagcattctggatgtggtgtacaaacctgaattcaggcaagagagtacggctgtgaggacgataaaattcataatctgtgcggctgcgggcactcctatatgctcaagtacagcgacgaaagggctttctaaaatatttgctgaattccatggcaacagcgctacgacaatggcgattgagcccacgtaaaagacgatgatgcgccatacaacggatctggtggcttttgtcacagattcgatcgggttggatgtttcccctgctgcaatggcaacgatttcagttcccataaaagagaagatgacaacgacaatgccgagcaatacggagctgatgccctccgggaaaaatccgcctttgcctgtaagattcgaaaaaccgactggctcactgcccggtgcaaagccaaaaataaaggcaaaaccaacgattagaaaagcaatgatagtcacaactttaatgagggagaaccaatattcaaactcaccgaaagacttaacggagtagacgtttgtcagggtgagcacaatggtcaagatcaaacttgtcagccacagcggaatatcatggaaccagtattgaataatgccagcaccggcaatggcttcgatcgcgatgacgatcacccagaaaaaccagtacagccagccgattgtaaatcctgcccacggtccgatggcgtcgtgagcgtattgagaaaacgatccgctcgtcgggtttacggcagacatctcaccgagcattctcataataaaaatcaccaataatccggctaacgcgtaagaaacaacggcacccggaccggtcgagtgaatcactgaaccgctgcctacaaataggccggctccgattacaccggcaatcgaaatcattgtcatatggcgggtctttaattccttttttaatcctgattgagattggttcataagttacctccttttaaaatgcaatcattactgaatattatgataattgaaactctatcataaatatacagtttgtcgaaaattcatgtgagaaaatataacgttttatttcaaatttgtagtgttttgtttgcgctttcagcgaatgtgtggaaaaaatgtttcgttttttatttgctgtgtgattttgtgtactatttacaattcgatagaatgcgagaagcgctggtgtcattggatctgatgggctttttggcggagcaaataaattggatgagagaaaaagtgttccatcgtcactatttttctgtggcgggtgaatcatgtttctgtagacccactgcggatcagctttgtaagataataataggaaaatgtgagcggggaggaggttttgtatggagagatatgatgaactgaaaaagggagaatccggagcgctggtcagcattgccgcgtatctagttctttccgcaattaaactgatcatcggttatctttttcactcggaagcacttacggcagacgggttaaataacacaactgacattattgcttctgttgctgtgctgattggcctgcgcatctctcaaaagcctcctgacgaagatcatccatacggccactttcgagcggaaacgattgcatcgcttatcgcatcgtttattatgatggttgtcggcctgcaagtgctgttcagcgccggagaatctattttttctgctaaacaagagacgccggatatgattgcggcttggacggcagcgggcggggcagtcctgatgctgatcgtttaccggtacaataaaaggctggccaaaaaggtgaagagccaggcgctccttgctgcggctgctgataataaatccgacgcattcgtcagtatcggcacatttatcggcattgtagctgctcaattccatcttgcttggattgatacggtcactgcgtttgtgatcggtctgcttatttgcaagaccgcatgggatatctttaaagagtcatctcactctttgacagatggattcgacataaaggacatttccgcttataaacagacaatcgaaaaaatctccggtgtgagccgtttaaaagacataaaagcaagatacttgggcagtacggttcatgttgatgtggtggttgaggtatcggcagatttaaatattacggaaagccacgatatagccaatgaaattgagcggagaatgaaggaggagcatgcgattgattattcgcatgttcatatggagcctttagaacacaaataattgagcttcctgccacaggaagcttttttgtgtgttttggccagctttattggaaacaatttgctagaatcgtttttttatacagattgctttttgtggtaaagttaggttacattatgatgaattttgtagatgactaggaggaaaagaatggcatatcaagaagacctgcatcctttgctggggaaagcagttgaacatattaatagagtaatggttggaaaacgagacatcgccatactcagcttagcagcccttcttgccaaagggcatgtgctgcttgaggatgtacccggagtcggaaaaacgatgatggtccgcgcgctggcaaagtcaatcggcgctgatttcaaaagaatccaattcactccggatttgctgccatctgatgtaacaggggtatctatctataatgcgaaaacgatggaatttgaatatcgtcccggcccgattatgggaaatatcgtgctggccgatgaaatcaaccgtacctctccgaagacacagtcggctttgctcgaagcgatggaagaggggagcgtcacggtagatggccatacgatgcagcttgccgatccgttttttgtgatggcaacgcaaaacccggtcgaatatgaaggaacctatcctttgccggaagcccagcttgaccggtttttattcaaacttcggatgggttatccgtcctttaatgaagagcttgacgtcttatctcttcaggaaaaaagccatccgattgagacgcttgagccgattattgcaaaagaagacttcatccgtttacagcgggaagtgcaaaatgtccgtgctgatgacagcattaaggaatatatcgttgaaatcgtgcagaaaacgagacagcatccttctgttcaattaggcgtcagtccgcgcggctcaatcgccctcatgaaagcggcacaggcatacgcactgctgcatcatcgcgactatgtcataccggatgatattcaatatttagctcctttcacgctgccgcaccggatgatgcttcatcctgaggcaaaatttgaagggattcaggcagaagcgatcgtaagggagatcatgtcagctgtgaaggtgccggttcaaaggtcgtcggtccgctgatgaataagaaatggcaatggctcgtatatggttggaagctgattatattaactttattgacggctgctgttttttcttatgcgatgtttcagggcggctttgtcagctggtttttgttttacgcgtttctcccttttgtcttgtatgccgggctgctggccttgtatccgctccgttcttttcaggcttcaaggcaaatggatagaacacaattgcatgcgggggacaggctgggcgtaactgttacgctgagaagaaagctgccatttccgctgatgtatatggtgattgaagattgcctgccagaaggtatcgagtcattaaatcgagacggagccgcggccaaacggctcgtttttccttggtttaaacggagcatgacgatgtcctatgaattagctcgggtaccgcgcggagagcatcactttcattctgtcagggtgcgaaccggggatgttcttggcttgattgaaaaaacagcattttttgagctggatgacaccctgtttgtttatccatcctttcagcgtttttcctatcaggtgaatgagaggcatcaggaagacggtgtaagcggttcttctcctattcatcagcaccattcctcagtcgcagcaagtgtgcggaattatcagccgggagaccggtttgctgcgttagattggaagacctctgcacggcggagccagctgatgacgaaggaatttgagccttctcgcagcaaaaatctgtttctgctgatggaccgtttttcctcagacgcattcgaagaggtcgtttcagtgacagcttcgattcttcattctgttttaaaaaacggcgcgggtgctggtctggcttccatcgggaaggaaaaaaacattttccctattcaggaaggggatcagcattttaagcacatgcttcggcatttagccatcgctcattgtgatgcggcagacccgataagccgatatgcacgggaagagctgggaaagccatctgttcgccaagctgatcaagttgttgtcacgggacagttaacggaagatatgctgcacctcgcagaaataggaggcggccgggttacggtgatactggcaaaagagaaagatgctgagctctctcaagctgaaaatgtcatgattgaacgcatgatgaaacgccaaatcagagttcgggtcatgaggggcgggcgagtttcgcgtgttgtttagaaagagaggtgactggttcacatgccgcacgatgatcacaagggaagccgtttgagcttgctgttattttattttctggcttttttattgctgtgggagtggctcaggccgcttgacagttttactgaaacgaaacatacaggcttttttagtgtctttatcggtttgacgtttctgctgacttttttcaggatgaggtggtttgtcaccgttcctttttgtgtcatatttacattgatctcgatacacatcctgttttatcaaggatctatattcgacttgagctgggtcagctcttttttgcaggatgtctatctgaatatcacgctgattcaatctgggcaatggaatgacatgattccttcatttcggaccctgctgttttttgtgctgctgtggctgctggtctatctcctgcattattgggtgatttaccagagaagaattttgtttttctttatgatgacagtagcgtatattacgattcttgatacctttacgccatatgatgccacttttgccgtcatccgtatcgtgctgatcggcttctttatgctgggccttttatacttggagcgcattaagctgatggaaagaatcacactgccaaaaacatctgtcctgaaatggtttcttcctttatctgtattggttttggctgcaacgggattcggactcgccgctccaaaatcagatccggcctggcctgatccggtgccttttcttaaaaaaatcactcatcaagaccgcgtgtctgcaggggaaagcaaaatcggatacgggaatcatgatgaatcactcggcggcccgttccagcaggatgctacacctgtttttacatggcagggaaaagagcgtacgtatttccgtgtggaaacgaaggatacgtataccgggaaaggctggattgaaacagacacaggcatgtcgtatcagcttagcaatggaaaagttgaaaatctgtggtttgaccataaagttgcgacagagcgccgcaccgtccgtgtaaaagtcgataagcactacgggtataaccatctgatgtatccgattggtgcggaaaccattcagccaaagcaggctgtctcacttgaaatgaacggcaacacggagcaaatttctccgatcagtgaacaagccggcgaaatcagaaatatggggaattatactgtaacgtacaattccccggtctataagctggatgaactgagaaaggtaaaagtgagaaaaaacagtgaggagtacacattcagcgatcgctacatgcagcttccagattcacttccagagcgggtgagaacccttgcgatcaaactgactcaggatcacgacaatatgtttgataaggtgaaagcggttgaggactatttagggtcaaatgcgttcacatatgaaacagaaaacgtgaccattccgaagaatgatgaagattatgtcgatcaatttctctttgaaacgaaaatgggttattgtgataacttttcttccgccatggtggtgctcttgcgctcggccgggattccggcccgctgggtaaagggttatacgtccggcgaatacaaagaagcaggaaacaaaaatggcaacatctacgaagtgacaaataacaatgcccattcctgggtagaggtgtatttcccggaacagggctgggttacatttgagccgactaaagggtttacaaatccggctgaatttacttcttctgacacaaaggactccggcagcgataacagcagctcgccgaagaaagcaaaacagaaagaagagaaaaaacagccgcaaaaagaggaaaaacaaaaggaaaagcgggagccagctgtttctaaaaagccgtccgcttcgcataccaatgccggtgcgggcttgtatgcagcgcttgcggttcttgcagtcctcctggtggcagctgtattgctgtatgttttccgctcgttatggattcctgttttcgccgtgaggaaattgaagcggcgcagcgatcagcacgcgttttttgaggcatatggcgcgctgctgaaacaactgaagagaaaaggactgccgaaacgagacagtgaaacgctgcgtgattatgcaaaacgaatcgatgaaaaatacgacatagaagacatgtcaaagctgacattaagctatgaaagggcgctttacagaaatgaagattcttcggcgctatggaatgattcgagagagttatgggaaaatttaattaaaagaagatggtcttgaccacttatcgacgtgttgttagaattagtgaatattatcggagtctgggagcgagttggcctgactccggcaaacggccttgccaaagagggcggagcgagcttcatatctgtcctcgtttttttctgtgtcaaaaaacttagaggagattaggtgacaaccatgacaaagttagtgaatgaaatgattcttgtccttgatttcggcagtcagtataaccagctgattacacgccgtatccgtgaattcggtgtatacagcgagctgcatccacatacattgacggctgaagaaattaaaaaaatgaatccaaaaggaattattttatccggcggtccaaacagtgtgtatgatgaaaattctttccgctgtgacgagaaaatcttcgagcttgatattcctgttttgggaatttgctacggcatgcagctgatgactcattaccttggcggtaaagttgaagcggcaagccagcgtgaatacggaaaagcaaacatccacatcgaaggcacacctgatttgttcagagatcttccgaatgaacaagtggtttggatgagccacggcgatttggttgtagaagttcctgaaggcttcactgttgacgcgacaagccatcactgcccgaactcagcaatgagcaaagcagacaaaaaatggtacggcgttcagttccacccggaagtgcgccactccgaatacggcaatgatcttctgaaaaactttgtattcggtgtttgcgaatgcgaaggcgaatggtcaatggagaactttatcgaaatcgaaatgcaaaaaatccgtgaaacggtcggagacaaacaggttctttgcgcgctaagcggcggcgttgattcctctgttgttgctgttttgattcataaagcgatcggcgaccagctgacttgtatctttgtagaccatggtcttctccgtaaaggcgaagctgagggtgttatgaaaacattcagcgaaggctttaacatgaacgtgattaaagtagacgcacaagatcgattcttagataaactaaaaggcgtttctgatcctgagcaaaaacgcaaaatcatcggtaatgaattcatttacgtattcgatgatgaagcggacaagctcaaaggcatcgactaccttgcacaaggtacgctttacacagatatcatcgagagcggtacagcaacggcacaaacgatcaaatctcaccacaatgtcggcggacttcctgaagacatgcagtttgagctgatcgagccgttaaacacgctcttcaaagacgaagtgcgcgcgcttggcacagagctcggcattccggatgaaatcgtatggcgtcagccgttcccaggaccgggactcggaatccgcgttcttggcgaagtaacagaagaaaaacttgaaatcgttcgtgaatcagatgcaatcttgcgtgaagaaattgcaaatcacggcttagagcgtgatatctggcaatacttcactgttcttcctgacatccgcagcgttggtgttatgggtgacgcaagaacatatgattacacaatcggaatccgtgccgttacatcaatcgacggcatgacatctgactgggcgcgtatcccgtgggatgtgcttgaagtcatttcgacacgtatcgtaaacgaagtgaagcacattaaccgcgtggtgtacgatattacaagtaagccgcctgcgacgattgagtgggaataagaatcaattaatggaaaccatctttttggcaattttgccgggaagatggttttatttgtttattacgaacaaaatccgattttgtgtgactattgttcgctttttgtattgttttttcaaaatgaagttggtacaatagacacagaaatcaaataagatgaattcgtataatcgcgggaatatggctcgcaagtctctaccaagctaccgtaaatggcttgactacgtaaacatttctttcgtttgatataaataaaacacgtttatttattcgaactgaaatccgtctgtagtcaagcgtcccaaaatgtattggggcgttttttatttggcgttttcaggacagaataaatagcaaagagtgaagggagtcaaatagcttgaaaacgttttttcagtttgatgagctgggcaccagctatcgcaatgaaatcattggcggattaacgacttttttatctatggcatatattttgttcgtcaatccgattacgcttgctttggacagcgtgaaagattttccggaggcgctgagaattgaccagggtgcagtctttacggcgacagcgctggcgtctgcagcaggctgtatcttaatgggattaatagcgagatatccgattgccattgcgccgggtatgggtctgaacgcgttttttgcgttttctgttgtccttggtatgggtatttcatggcaggcagctttgtccggtgtttttatttcaggtcttattttcgttgctctttctttaacaggttttcgtgaaaaaatcatcaacgccattccgcctgagctgaaattggcagtcggtgcggggatcggcctgtttattacattcgttggcttacaaggctcaggaatcattactgcaaatccttctacgctcgtcacgatcggaaacattcacagcggacctgtgctgttaacgattttcggtgtgattgtcacggttattttaatggtgcttcgcgtgaacgcaggcgtgtttatcgggatgctattaacagcggtagccggcatgattttcggtttggttccggttccgactcaaattataggcagtgtgccaagccttgcgccgactttcggacaagcgtggattcacctcccggatattttctctgtacaaatgctgatcgttattttaacattcttgtttgtcggattttttgatacagctggtacacttgttgctgtggcaacacaagctggtttaatgaaggaaaacaaattgccgcgtgcgggccgtgcgcttttagctgattcatcttctattgtgatcggtgccgtgcttggtacatctacaacaacttcttacgtggaatcaagctcaggtgtcgctgcgggtgcccgttcaggatttgccgcaattgtaacagggattctctttttactggctacgtttttctctccgcttctatcagtcgttacgtcaaatgtaacagcgccggcgcttattatcgttggtgcattgatggtggcgccgcttggcaaaatcgcttgggataagttcgaagtggccgttcctgctttccttaccatgatcatgatgccgttaacgtacagcatcgcgactggtattgccatcggatttattttctatccgattacaatggtgtgcaaaggaaaagcaaaagaggttcacccaatcatgtacgggctgtttgtcgtatttatcctgtactttatcttcttaaaataagaattgaaaaaccagctgcaccggcagctggttttttgttgcaaaagataaaaccatttcatacgatataccgtcatgtagatgtgccgccatgctttacttaaatggaaatgacttgactgttcaggaaggcttcggtaccttatataagtgttttattttcttgctgaatggtattccgccgtatttttttgataggagttgctgacatgacggaagaaagaaaagaaacgtttgaagaagaaattaaccagagtgaaagaatagatgcagatgaagaaccgctatcgagaatgtccagaaaggcgagccggcaaagcaagcagaagcaaaaacaaaagcagaaaccgcgccaggaacgcggtgaatcaactgttaaagacaagcttgcgtctgtttgggcagccatcaacagatattgcggttttgcgttctcgattttaaaatcaccggcgaaaactgtcgtaacggatggtttttctcattataagtacggtctgatttcaatgcttatattcagtatcattttttcaattgggaattggtttcagttaaaggcaagctggaatcggccgctcggtttcggagaacgccatcatgctttctatgacgggtttttagttgttcttgtgtatttgctgatctttttcgcggtaatggtctttgctatatgggctgtctcccgctatatgatgaagcagaaggtgacgttcagagaagcggctgccgtattgggttcattgcttgtaccggtaattgctgtttcaatcctttggctgatctttgcgatcgtaaatatcccaatgctgacagtactgtttacggtgctgatcttgttttccatcttttttatcatcgcgctgtatgtacagcgtgtgtaccaggcggcacaagatgcaccaattgattatatctattgtgtatttgcagtggttgcgatagcgctgctgtttacggcagtgacttggccttttatttcggaatattttacggcgtcgctgattccgctttaatgaaaaaaccggctaatcctagccggtttttttatgtcacactttttacaaatatatctaaaaaacatagttgatttgtaggattaacccgtgtatgatggggaaaatgctgaaaacgtccagcgcaaaaacctttatgtttaaggaggatgatggacatggctgatgtgcttcgccgagcaattaaccaaaagaagcaatttttaaaaaccaaattactgctctcggaattttatcaaggaagaggggaacagcttgctgactacacgctgagtgagcttgagaaagaatacaagtcccttcagaaaatgaaaaaagagatctgacaatagatataaagaggtgagtctgctgaaaagcgggcttttttgttttgattttgaaaaggcgagaaagagggtaaactactactgttcaacgcataaaagcatgtcgaaatattttgcttaagcttacgggcgaagctgattgtaaacggctcatttctctagtagaatatgaatgctttgtgcaagctgaagagtagggggatgaataaaatgatgcaaaccatcttatcaaatgggatagccatggttctcataattctcattattaatattgtctatgtgtcattttttacgataagaatgattttaacgctgaaaggacagcgttatttagcggccggcatcagtacgattgaaatactggtttatgtgacagggctgagtctggtgctcgataacttagaccagattcaaaatgtgatcgcgtacgcgctcggttacggtcttggcgtaattgtcggcatgaaaatagaagaaaaattggcgcttggctatattatggtcaatgtgattacgaaggagctcgatcttgatcttccgaagcagctccgtgaaaaaggctacggcgtgacaaactgggtggcaggcgggcttgaaggcgaccgcacagcccttcagatcctgacgccgagaaaatatgaactccagctatatgatacgattaaaacacttgattcaaaagcctttattattgcgtacgaaccaaaaacaatccacggcggcttctgggtcaaagcggtgaagaagaggagaattaaagaataatggcaaagccgaagaagaaaaagtttgaagtgacagagcagcaaacgattgatgcggtgcttcagcaaatgaaagaagaaggatatctgcctgtaaggcgaatggaagaacctatttttatggaaaaaaaggaaaatgggtcaattcagatcgttccgtgcgggaaaaaaatcgtatttgaagggaaattgatctaaaacacgaacattagtagaatgaatttttgtatcgttcgataatatcgttgacattatccatgtccgttgttaagataaacatgaaatcaaaacacgacctcatataatcttggaatatggcccataagtttctacccggcaaccgtaaattgccggactatgcaggaaagtgatcgataaaactgacatggatatatcgcagaagcgaacgactgacgatacatgtaccatgcccggtttgtattgcttcctcataagtgcaatgcagagcgggtattttttattttctgaaaacaaaagcattagaaggtggggaacagaatgcagccgctagtaggaatcatcatgggaagcacttccgattgggagacaatgaaacacgcatgcgacatacttgacgaactcaatgttccgtacgaaaaaaaggtcgtttccgctcaccggacgcctgatttcatgtttgaatatgctgaaactgctagagaaagaggcatcaaggtgattattgccggtgccggaggagcggcgcatctgccagggatgacggctgcgaaaacaacactgccagtcattggagttccggttcagtccaaggcgctgaacggaatggattcacttctttccatcgtccaaatgcctggaggcgtgcctgttgcgacaacatccatcggcaaagcgggtgctgtgaacgcaggcctgttagcggcgcaaattttgtcagcatttgacgaaggccttgcccgtaagctggatgagagaagagaaaatacaaaacagacagtgttagaaagcagtgatcagcttgtctaaacaaatcatctatccgggagctgtaatcggcattatcggcggcggccagcttgggaaaatgatggctgtgtccgccaaacaaatggggtataaagtcgcggtcgttgatccggtgaaagattcgccgtgcgggcaggttgcggatgtcgaaattaccgctcattataatgaccgtgaagcgattcgaaaattggctgaaatcagcgatatcatcacatatgagtttgaaaacatcgactatgatgcgctgcattggctaaaagatcatgcgtatctcccgcaaggaagtgagctgctgctcattacccaaaaccgtgaaacagagaaaaaagcaattcaatccgcgggctgtgaagtcgcaccgtacagcatcgtcaaaacaaagaatgaattgaaacaggcggtacaggagctcgggttacccgcagttctgaagacatgtcgcggcgggtacgacggcaaaggccaatttgtgataaaagaagaggcgcaaatggagcaggcagccgctctgttagaacacggaacttgcattcttgaaagctgggtttcttttaaaatggaactgtcggtgatcgtcgttagatcggtaaacggtgaaatttcaacatttccgacagctgaaaacattcaccacaacaatattcttttccaaagcatcgtgcccgcacgggtagagaaagggattcagcagaaggctgctgatctcgcagttaagcttgcagatgagcttaaccttgtcggaccgcttgctgttgagatgttcctgacagaggacggagagcttttggtcaatgaactggcgccaagaccgcacaattctgggcattatacgctggacctttgcgagtcgaaccagtttgagcagcatatcagagcagtatgcgggcttccgcttgggaagacagatttgctgaagccgggcatgatggtgaatcttctcggcgatgaagtgaagcttgttgaggaagatccggagcttttaaaagaggcaaagctatatatatacggaaaacatgaaatcaaaaaaggccgcaaaatggggcatattacatttatgaagcagcctgaagacgaatggattcaggagatcacaaataaatggatgaatagagacggaggacaagcagaatgatcgaacgttattcaagacctgaaatgtccgcgatttggacggatgaaaacagatttcaagcatggctggaggtagagattcttgcctgtgaagcgtgggcggagcttggcgtcattccgaaagaagatgtaaaagttatgcgtgagaacgcatcatttgacatcaaccgcattttagaaatcgaacaggacacgcgccatgacgttgtcgcttttacgcgcgctgtatccgaatcactgggcgaagaaagaaaatgggtgcattacggcttaacgtcaactgacgttgttgatacggctctttcctacttattaaaacaggcaaacgatattttgctcaaggatcttgagagatttgttgacattattaaagaaaaagcgaaagaacataaatacacagtcatgatggggcgcacgcacggcgtacacgctgagcctacaactttcggcttaaaacttgcgctttggcatgaagaaatgaaacgtaatcttgagcgcttcaaacaagcgaaagcaggcatcgaggttggaaagatttctggcgctgtcggcacatatgcgaacattgatccatttgttgaacaatatgtctgtgagaagctcggattgaaagcagcaccgatttcaactcaaacccttcagcgtgaccgccatgctgactatatggcaacacttgctttgattgcgacaagcatcgagaaattcgctgtggaaatccgcggactgcaaaagagtgaaacacgtgaagtagaggaattttttgcgaaagggcaaaagggttcatctgcaatgccgcataaacgaaatccgattggctctgaaaacatgacaggcatggcgcgcgtgatccgcggctacatgatgacagcttacgaaaatgttccattatggcatgagcgcgatatttctcattcttcagcagaacgaattattcttccggatgcgacaattgcgctgaactacatgctgaaccgcttctccaacatcgtgaagaacttaacggtcttcccggaaaacatgaagcgcaacatggaccgcactctcggtcttatctattctcagcgtgtgctgcttgctttgattgacacaggcctgactcgtgaagaagcctatgatacagttcagccgaaagcaatggaagcgtgggaaaaacaagtgccgttccgcgagcttgttgaagcggaagagaaaatcacgtcacgtctttctccagaaaaaattgctgactgctttgattacaattaccatctgaaaaatgttgatctgatctttgaacgtttaggtttagcatagaagaagcttttagcggcttcttctaagccgccgcagtttgaaaattcccaacattcgggttaggaggccttccgtgaatattgtgaagaatgaacttttatacgaaggaaaagcaaaaaagatctacaaaaccgatgacgaaaacacgctgtatgtcgtgtataaagactccgccactgcctttaacggcgagaaaaaagcagaaatcagcgggaaagggcgcttaaataacgagatttcaagcttaattttcaaacaccttcatgcaaagggcattaacaatcattttatcgagcgcatttcggaaacggaacagctcattaaaaaggtaacgattgtgccgcttgaagtcgtggtcagaaatgttgtggcaggaagcatgtccaaacgtctcggcattccagaaggcacggagcttgagcagccgattatcgagttttactacaaggatgacgcgctgggtgatccgctcatcacagaagatcatatttggcttttgaaagcggcgactcctgagcaggtagaaaccattaagtccattacaaaaacagtaaatgaagagcttcaaagcattttcggcgattgtcatgtcagattaatagatttcaagcttgaattcggtttagatgcagaagggcaagtgcttttggcggatgaaatttctcctgacacatgccgcttgtgggataaagacacgaacgaaaagctggataaagatttattcagacgcaatctgggaagcttaaccgacgcatacgaagagattttcaaaagactgggaggcattcatcatgtataaagtaaaagtttatgtcagcttaaaagaaagtgtactagatccacaagggagcgctgtccagcatgccttgcacagtatgacttacaacgaagttcaagatgtgcgcatcgggaaatacatggagcttaccattgaaaaatctgaccgtgatcttgacgtgctagtgaaagaaatgtgcgaaaaacttcttgcgaacacagtgattgaagattacagatatgaggttgaggaggtagtcgcacagtgaaatttgcggtgattgtgttacccggctccaactgtgatatcgatatgtatcatgctgtaaaggatgagctcggccatgaagtggaatacgtctggcatgaggaaacaagtcttgacggcttcgacggcgtgttaattccgggagggttttcttacggcgattacttaagatgcggcgccatcgcccgatttgcgaatattatgccagctgtcaaacaagcagcggctgaaggaaaacctgttcttggcgtctgcaacggattccagattttacaggagcttgggctgctgccaggcgcaatgagacgcaacaaagatctgaagttcatttgccgtccggttgaattaattgttcagaacgacgaaacattattcacagcttcctacgaaaagggacaatcgattacaatcccggttgcccacggtgaaggaaatttctattgtgatgacgagacgcttgcttcattaaaggaaaacaatcaaattgctttcacatacggatctaatatcaatggaagtgtcagcgacattgccggtgtcgtcaatgagaaaggcaacgtattaggcatgatgcctcatcctgagcgcgcggtcgatgaactgcttggaagcgccgacggtcttaaattgttccagtctatcgtgaaaaattggagggaaactcatgtcactactgcttgaaccaagtaaagaacaaataaaagaagagaaactatatcagcaaatgggtgtcagtgatgatgagtttgcattgatagaatccattcttggaagattgccgaactacacagaaatcggaattttttctgtcatgtggtctgagcattgcagctacaaaaactcaaagccgattctgcgtaagttcccgacaagcggcgagcgtgtgctgcaggggcctggggaaggcgccggaatcgttgatatcggtgataaccaagcggttgtgttcaaaattgaatcacataaccacccatcagctctcgagccttaccaaggcgctgcgactggcgtaggcggaattatccgtgatgtattctcaatgggtgcacgtccaatcgctgtattgaactctcttcgatttggtgaactgacttcaccccgcgtgaagtacttgtttgaagaagtagtagcgggtatcgccggatacggcaactgtatcggcatcccgacagtcggcggagaagtgcagtttgacagcagctatgaaggaaatccgctcgtcaacgcaatgtgcgtcggtttaatcaaccatgaagacatcaaaaaaggccaggcaaagggtgtcggcaacacagtaatgtacgtaggagcgaaaacagggcgtgacggaatccacggcgctacgtttgcttctgaagaaatgtcagactcgtctgaagaaaagcgttctgctgtccaagtcggcgatccgtttatggagaagcttttgcttgaagcatgtctggaagtcatccaatgcgacgccttagtcggcattcaggatatgggagctgccggtttaacaagctcaagtgcagaaatggcaagtaaagccggttctggtattgaaatgaaccttgacctgattcctcagcgcgaaacaggcatgaccgcgtatgaaatgatgctttctgaatcacaagaacggatgcttttggttattgagcgcggacgtgagcaggaaatcatcgatatttttgacaagtatgatcttgaagcggtttctgtcggacatgtgacagatgataaaatgcttcgcctgacacacaaaggagaggttgtgtgcgagctgcctgttgatgccttggcagaagaagcaccggtttaccataagccttctcaagagcctgcttactatcgcgagtttttggaaacggacgttccggctccgcaaattgaagatgcgaatgaaacgctgaaggcccttcttcagcagccgacgattgcgagtaaagagtgggtttatgatcagtatgactacatggtgcgcacgaatacagttgtcgctcctgggtctgatgctggtgttctcagaatccgcggaacgaaaaaggcgctggcgatgacgacagactgtaacgcgcgttatctctatctcgatcctgaagtcggcgggaaaattgctgtcgctgaagcagcgcgcaacatcatttgctcaggcgcagaaccgcttgcggtcacagataaccttaacttcggaaacccggagaagccggaaatcttctggcagatcgaaaaagcggcagacggcataagcgaagcgtgcaatgttctcagcacaccggttatcggcggtaacgtatcgctttataacgaatcaaacggcacggcgatctatccgacaccagttatcggaatggtcggcttaattgaagatacagcacacattacaacacagcatttcaaacaagcgggagatctcgtatatgtgatcggtgaaacaaaaccagagtttgccggaagcgagctgcaaaaaatgacagaaggccgtatttacggcaaagccccgcaaatcgatcttgatgtagagctgtctcgtcaaaaagcactgcttgacgcgattaaaaaaggcttcgttcaatctgcgcatgatgtgtctgaaggcggcttaggcgtagcgattgcggaaagtgtcatgacgacggaaaaccttggcgctaatgtgactgtagaaggggaagcggcattattattctctgaatctcaatcccgcttcgtcgtttcagtgaaaaaagaacatcaagaagcgtttgaagcaactgtcaaagatgcggttcatattggtgaggtaacagctgacggaattctggcgattcaaaaccaagatggacaacaaatgattcatgcgcaaacgaaagagcttgaacgcgtatggaaaggagctatcccatgcttgctgaaatcaaaggcttaaatgaagaatgcggcgtttttgggatttggggacatgaagaagccccgcagatcacgtattacggtctccacagccttcagcaccgaggacaggagggtgcgggcatcgtagcgactgacggtgaaaagctgacggctcacaaaggccaaggtctgatcactgaagtatttcaaaatggcgaactcagcaaagtaaagggaaaaggcgctatcgggcacgttcggtacgcaacggctggaggcggcggatacgaaaatgtacagccgctcctcttccgttcccaaaacaacggcagcctggcgcttgctcataacggaaaccttgtcaacgccactcagctgaagcagcagctcgaaaatcaagggagcatttttcaaacctcttcggatacagaggttttggcccatctgatcaaaagaagcggccacttcacactgaaggatcaaattaaaaactcgctttccatgctgaaaggcgcctacgcgttcctgatcatgaccgaaaccgaaatgattgtcgcgcttgacccgaacgggcttagaccgctgtcgatcggcatgatgggcgacgcttatgtggtcgcatcagaaacatgcgcatttgacgtcgtcggcgcaacgtaccttcgcgaggtagagccgggggaaatgctgatcattaatgatgaaggcatgaaatcagagcgtttttccatgaatatcaatcgttccatttgcagcatggagtacatttatttctccagaccagacagcaatattgacggtattaatgtgcacagtgcccgtaaaaaccttgggaaaatgctggctcaggaatccgcagttgaagctgacgtcgtaactggggttccggattccagtatttctgcggcgatcggctatgcagaggcaacaggcattccgtatgagctgggcttaatcaaaaaccgctatgtcggcagaacatttattcagccctcccaggctctgcgtgagcaaggcgttagaatgaagctgtctgcggtgcgcggggttgtagaaggcaaacgcgtcgtgatggtggatgactctatcgtacgcggaacaactagccgccggattgtcacgatgcttagagaagcgggtgcgacagaggtgcatgtgaaaatcagttcaccgccgatcgctcatccgtgcttttacggcattgatacttccacacatgaagaattaatcgcgtcttcgcattctgttgaagaaatccgtcaggaaatcggagccgataccctctcatttttgagtgtggaagggctgctgaaaggcatcggcagaaaatacgatgactcgaattgcggacagtgtctcgcttgctttacaggaaaatatccgactgaaatttaccaggatacagtgcttcctcacgtaaaagaagcagtattaaccaaataaaacttgaaaaatgacataaaggcagcgcagttaggctgcctttctctttctgccctctttcggggagatattttgaaaagcgccttaaaggagtgaataggatgtctgaagcatataaaaacgcaggagttgacatcgaagccggatatgaagctgtaaaacgaatgaaaaaacacgtggagcgcacgaaacggcttggcgttatgggcagccttggcggttttggcggcatgtttgacctgtctgagctttcttatcaaaaaccagttctcatttcgggaacggacggtgtcggcacaaaattaaagctcgctttttccatggataagcatgacacgattggcgtggacgctgttgcaatgtgtgtcaatgacgtgctggcacaaggtgcagagccgctgtttttcctcgattatttagcggtcggcaaagcggacccagtgaaaattgaacagattgtacaaggtgtggcggaaggctgtgagcagtcaggttcagccttagtcggcggtgaaacggctgaaatgccgggactctatacagttgatgaatacgatattgccggtttctcagtcggagtggcagaaaaggacgaaatcgtgactggagaaaacatcgaagagggccatcttttgatcggcctcagctccagcggccttcacagcaacggattttcccttgtcagaaaagtgcttctggatgatgcggagctggaccttgatacaacatatgagccgtttgaacgcccgcttggcgaggaattgcttgaaccgacaaggatttacgtgaagcctgtgcttgccgcggtcaaaagcggaaaaatcgacggcatggcgcacgtgacaggcggaggatttatagaaaatattccgcgtatgcttccggaaggcttaagtgcggaaattgatcatggctcatggccgatcccgccaattttttctttcttgcaagagtacggcaagctaaaggaagaagacatgttcaacgtctttaatatgggtatcggttttgttttggcagtcaaagaagagcatctgacagatgtgatcggaacgcttgaaagccatggcgaaaaagcctatttaattgggcgtgtgaaaaaaggtgaaggcgtcacattcggcggtgcggcactttcatgaaaaagtttgcggtatttgcatcaggaaacggttcaaacttcgaagccatcgtcacgcgtttgaaggaggagaactgggatgcgtcagcagcgctcctcgtttgcgacaaaccgcaggcgaaagtcatcgaacgggcggaagcattccacattccatccttcgcatttgagccgaagtcttatgaaaacaaggctgcatttgaaaaagccatcattgaacagcttcgccttcacgaggttgaattgattgttcttgccggctatatgaggctgatcggtgatacgctccttcaagcatatggaggaaaaatcattaacattcacccgtcgcttcttccggcgtttcctggaatcgacgcagtcggacaggcataccgggcgggtgtgaaggtggccggaatcaccgtgcattatgtcgatgaaggaatggatacaggtccgatcatcgctcaaaaggcaatcgaaattgatgaacatgatacattggaaacaatcgaacagcgaattcacaagcttgagcataaatggtatccgagtgtgattaaacagctattaggattaaataacagaggtgaaaaggcatgaccattaaacgtgcattaatcagtgtttcagataaaacaaatctcgttcctttcgtaaaagaactgacagagcttggcgttgaagtcatctccacaggcggaacgaaaaagctgcttcaagaaaacggtgtagatgtgatcggaatttctgaagtgacaggctttcctgaaattatggacggccggttaaaaacccttcacccgaatattcacggcggtcttctggcggttcgcggcaatgaagagcatatggcgcagatcaataaacacgggattcagccgattgacctcgttgtcgtcaacctctatccatttaaagaaacgatttctaaagaagacgtcacgtatgaagaagcgatcgaaaatatcgacatcggcggacctggcatgctgcgtgcggcatcaaagaaccatcaggatgtcacggttatcgtcgatccggccgattacagcccagtgctaaatcaaatcaaagaagaaggcagcgtatctcttcagaaaaaacgcgagctcgcggcaaaagtattccgtcatactgcggcatatgatgcactgatcgctgactacctgacaaatgttgtcggtgaaaaagaaccagagcaattcactgtgacatttgagaaaaaacaatcgcttcgctatggagaaaacccgcatcaggaagcaactttctatcaaacagctcttcctgtcaaaggctctattgcgcaagcagaacagcttcacggaaaagagctttcttacaacaatattaaagacgcggatgcggcagttcaaatcgttcgtgaattcactgagccggctgctgttgctgtaaagcatatgaatccgtgcggtgtaggaacaggaaaaacgatcgccgaagcgtttgacagagcgtttgaagcggataaaacatctatcttcggcggcattatcgcgctgaaccgtgaagtggacaaggcaactgccgaagcgcttcacaacattttcttagaaatcatcattgcaccttcattcagccaagaagcgctcgacgtcctgactgcgaagaaaaatctccgtctgctgacgcttgacgtatccgccgctgttcaaaaggaaaaacagctgacatctgttcaaggcgggctgctgattcaagatttagatatgcacggcttcgttgatgctgagattagcattccgacaaaaagagaaccgaacgagcaagagtgggaagacttgaagcttgcttggaaagtcgtgaaacatgtgaaatcaaatgcgatagttctcgcgaaggacaacatgacagtcggcgtgggagcaggccaaatgaaccgcgtcggatcggcaaaaatcgcaatcgagcaagcaggggaaaaagcgaagggcagcgcgctcggttcggatgcatatttcccaatgccagatactgttgaagaagcggcaaaagcgggcgttacagccatcattcagccaggcggatcgatccgtgatgaggattctatcaaaaaagcggatgaatacggcattgccatggtattcaccggcatcagacacttcaaacattaaggggatgaaaacgacgtgaatgtattaattatcggtaaaggcggaagagagcatacgctggcgtggaaggcggcgcaaagcagcctcgtcgagaatgtatttgccgctcccggaaatgacggcatggcagcttctgcacagcttgtaaacattgaggagagcgaccacgcagggcttgtctcatttgcaaaagaaaaccaggtcggcctgaccattgtcggccctgaggttcctttaattgaaggtctggtggatgaattcgaaaaagcgggcttacgtgtgttcggcccgtcaaaagccgcggcgatcatcgaaggaagcaaacagttcgctaaggatttaatgaagaaatacgacattccgaccgcagaatacgacacgtttacatcctttgaagaggcgaaggcatatgtgcaggaaaaaggtgctccgattgtgataaaagcagatggacttgcagctggaaaaggcgttactgtggctatgacagaggaagaagcaattgcgtgtctgcatgactttcttgaagatgaaaagttcggtgatgcgagcgcgtccgttgtcattgaagaatatctttctggtgaagaattttctctgatggcctttgtcaaaggggaaaaggtgtatccgatggtgattgcccaggatcacaagcgtgcgtttgacggagacaaaggcccgaatacgggcggaatgggcgcttactctccagttccgcaaatttcggaagaaacggttcgccatgctgtagaaacgatcgttaagccggccgcaaaagcaatggtacaagaaggccgttccttcactggcgttttgtacgctggattgatgcttactgaaaacggctcgaaggtcattgaatttaatgcccgtttcggcgatccggaaacacaggtcgtgcttccgcgcatggaatctgatctggtacaggtgcttcttgatcttttagatgataaggaagttgacttaagatggaaggataccgcggcagtgagtgttgtgcttgcatcagaagggtatccggaaagctacgcaaaaggcacgccgatcggcagccttgcagcagaaactgagcaggtcgtggtcttccatgccggaacgaaagcagaaggcggagagtttgttacaaacggggggcgcgtcgccaatgtgacagcttttgatgaatcgtttgaagcggctagagaccgagtgtacaaagcggttgatgaaatattcaaaccgggactctttttcagaaaagatattggggcacgcgctttaaaggctgcccaaaaataagtgaggaaaacccgcagattagctgcgggttttttgttatcaaaaagcgggatggcagctagaagaagaaagcacaacgagcgtggttggttttccatgggccatcgaggcgtcaataaaatcctcaagcgtatgtaccgattcagtcacgacctttgtcacatagctgtacatccccgtgatgcggtggttttctgctacatcaggatgcgatgttgcaaaggcggcgtagtgcttgcagcttttcggctccatgagaataaaagcggtgacatgcttgtttagtttttcgtaacagatattcgcgctgtagccggtaatcactcctttgtcttccagcttcctgacacgctccgccgcgcttggcgagctgagtccgacaagctttcccagctcaaccatcgttaatctgccgtttcgctgcaaatgcgagagaatctgaaggtctgtatcgtccatttgtctggctcctttacatatttaggcgaatgaatgaaaattcctttgatcgtaaggtaatgctgttgatttaacttcattgtagcatatggatgtcgtcttattttttctataataaagccatcaatcagagagggggcatcatgttgccagaattacagcgctctattacttggatacaagggacggcgttaacgattggggcggttttaggatgcgggatattaatcctgccgtctgtcaccgcggacacggccggtccggcttctttatttgtctgggtattcatgtcttttttatcttttcttcttgtcggcacgctggcccggcttgtgaaaatagcgcccatcgcgggaggaatcacggcttatgtgcagctggcctttcagaaaaaagccggggctattttgggctggatcatgttagggtccgttccgatcggcgttcccatcatcgctttgactggcgcgcattacgtcagttacatcacagaggcggccgattggcagattacattgattgctggttgcatgctggctatatctattttgcttcatatgagagggattcaactatcagcaaacattagtacacttgttatatgtgtcatcgtatttctgcttgtcacttctattgctgtgtcattgccacacgtcacgatagcagaattcaagccgtttcttccgcatggctggtctgctgctggatctgtttctgttatgatttttttctcttttgtaggctgggaaatgattaccccattggctgaggaatttcatcgtcctgaaaaagatgtcccgctcagcttgtttttggcagcgtcttgtgtggcgggactgtatatcatgctgtcatttgtgaccgtgggtactcattcatatggagagaatggagaaattgcatcgcttgccatgctcatctcaaaaggagcaggggaaagcggtgtatacgtcacggtatgtttagcgctgtttattacattcgctaccatccatgccaatattgctggtttttcaagaatggtgtacgcattggcgagagaggggcacatacccgtattttttggaaaactcagtgcgacaaaacgtacgcctattcgcgttttgacagcgatggccgcggtgtttggcttagtgcttgcagcgcatggcgtctttcaaatcgatttgacgactctgttgaaagggccgagcgcggcttttatcgcatcttacatatgtacattggcggcagcactgaaactcctgagctggagagattcaggctggtggatggcgctcggggcgtttgtggcgtgcgcggtgatttactcattcagcggctgggcgcttctttatccggcagtgctggcagctgcaggatatttctatataaaaacaaagggtgggcataaaaaaaagcttgatcacgttttgtgatcaagcttttccatttatccgttttgaggctcgttatttccagaatcactgtgttgaaacatgtaggtcacaggacagaagcgcaagattcccgaacccgctttcatggcccccataaagatgtaaaagagatgcattctgcaccaaggttttttcgtaaactttgcactggcggctgacataatcgtcaatccgcaggcgattctgaacacggcattgatgagactgatgtttggcttcaaggaaatccgctccttttacttaaaaaagttttttaatcgaaccttcaaaaatttgtaacgtttttatcgtgcgtgatgaggaaggatgtgataccatgagtctaatacatgtaaaggagagtatgtgaatgtccgaacgcacctttaactggaaaaacaaagacatcagggcacaggttgatgttgtagactcaaagctgcttccaacgctccttttacggaatgctctcgtcttaaatccatatgtaaaacaatggctgaaaaaaaacatttggatttatcaggaccgcattgtttatgtgggtcatgaacttccggatagagccgaagaaattcatacgattgattgtgaaggaaaatacattgtgccaggttatattgaaccgcacgcacatccttttcaaatatataatccccaaacactggcggaatatgtgtctcaatatggaacaacgacattcgtgaatgataacttatttttgcttttgcaaagcggaaaaaagaaagcgcttacgattttgaatgaactcaaaaagcagcctgtccagtatttttggtggtcacgctatgacctccagaccgaggttctgaacgaggaccacgtccttccatttgacgtcagaaaacagtggattgaacatccggatgtgattcaaggcggagaaatgaccggatggcctcgcctggtagatggtgatgatttaatgctccactgcatgcaagctacaaagaaacagagaaaacgcattgaagggcattttcccggcgcttctgataaaacgcttacaaaaatgaagctgttcggtgcggattgtgatcatgaagcgatgacaggtgatgaagtgatgagaaggctggaactgggctattatgtttcccttcggaactcttccattcgccctgatgtaagaaaaatcttgcaagaactgcatgagaagggcttccgctattatgaccacttcttttacacgacagatggcgcaacccgaatttctataaaggcggcatgacaaacgagctgattcgcatcgcgttagaagaaggcgtacctgcaatcgacgcctacaatatggcatcatttaatatcgcaaagtattaccaaatggatgattatttaggagttgtcggaccgggtagactggcatcgctcaacatactggaagatctgttaaatccgaatcccgtgactgttctgtcaaaagggactattctgcgtgaagacggctgtgatttgaaggcgtttacaaagacggactggcacaaaggcggtcttgtcccgcttgagctttcatatgatatgacgatggatgacttgcagttttctatgccgatgggcgtgaaaatgcggaatgcggttattatggagccatatatgattgagatcgacaattcgatggaacagctctcgtttgaccatgatgaaagttatttgttgatgctcgacagacacgggaaatggcgcgtcaatacgatgataaaagggtttgcctcaagcgtgcagggatttgtaagctcctttacgacgacgggcgacattgtcgcgattggaaaaaataaagcagatatgctgctcgctttcgcccgcatgaaagaaatcggaggaggaattgttttagcggagaacggaaacattctgcatgaaatcccgcttgcgctgtgcggctgcgcctcttcggaagcgtatgaagacgtgcttgagaaggaacaaaagctgagagatcttttgactgaaagaggctatgagttttgcgatcctatctatacgctgctctttttgcaaagtacgcaccttccgtatatacgtattacgccaagaggaatcttcgacgtcatgaaaaaaactgtactctttccatcgataatgcgttaaaatataaaagagcagggagccgacatatgaaaaaatggatgacagtttgcgcgctgtgtttcgtgttttttctgctggtatcctgccagcagaaggatgctgtcccggatactgcaaagaagctgaaagctcctttaacggggctaaagactgaacagaaggtgactgaacgccggcctgttgctgttgtggtgaacaatcacccgaaggcgaggccgcagtcgggtctgtctaaagccgacattgtcatagaagcgctagccgaagggcaaatcacaagatttctggccattttccaaagccagatgcctgaaactgtcggacctgtgcggagcgcgcgggaatatttcgtcactctcagcaatggctttgacagcatatttgtccatcacggctggagtcccggcgccaaagagcagctggaatccggagctgccgattatatgaacggattggattttgacggaagcttattttggagagctgatttcagcaaaccgccccacaattcctatacgtcttatgattacataaaaaaggcggcggaacaaaaaggttataagctgaagcaggaaacaaatccgctgctgtttcaaacatcagatgcaaaacctgcaaatgaatcttacaatgttcgggtagattatggaacaaaaaacgttacaaatcttgtcgaatacaactatgataaaaaagctgaatcttatacaagaagctctgatggtgtcataacgacagaccgggaaaccggaaagccggttgcaatgcaaaatattttcattgttgaagccagccatcatattattgatcaagatggaaggcgggacatcgacttggaatcagggggaaaaggtctgttgtttcagcacggaaacgtcattgaaacagactggaaacaagtgaatggcagaattgtgccggtaaaagacggcaagtggcttccgtttgtgccaggaaagacttggatcaatatcgtacctgatcttgatgcggcttccattagtaaaggagaaggtgtgtaacgatgcaaatcgataaattacgcggcaaagagctggaccagttatttaactcgatcttatcgctgaaagacctggaggaatgttaccgattcttcgatgatctatgcacaattaacgaaattcaatcgctggctcagcgccttgaagtggcgcgcatgcttcgcgaaggaaacacgtatcataagattgaaacagaaacaggcgcttccacggctacgatttcccgtgtgaaacgctgcttaaattacggaaatgacgcttatgaaatggcgcttgaccgtgtgaaggaaacggaaactgagtcttcttcaaaataacatagaaccgccctgccgttcggcaagggcggtttctttatgaaacaaattgatggatcaggttgtcgatatcgatgagactgccatcctctttccgatagacaacatgctccttggaaaaatgaatcggcgaattgatccctgctgcggctgcaaggttaaacagcccctcgcgcagggaaataacgtagttgcagacacgatgctgtttttcctcaacgctcaacgctttttgcaatttcggatctgtcgtcgccacacctgccggacaggtgttggtgtggcagacgagagcgcggatgcagccaacggaaaacatcatgccgcgtgcgatgttgacaaagtcagcgccgagggctaaggcgaccgcgattttatcaggagtcaggagctttccggaagcaaagattttcagctggctgcgcaagccgtactgtttaagaagcgtgtcaacaataggcagcgctgtcataattggaaggccgactgtatccgcgagctcgtaaaaggaagctccggtaccgccttcacttccgtcgatcgtgataaaatccggatgctttccgcttttctgcatataagagaaaagctcatgcaattcttcaggatgccctgcgaccagtttgatgccgactggcttttgtccgacatctctaagtttttcaataaagtcgagcatttcaggagggttcgagaattcataaaagcggttcgggctgtcaatcgactttccaggttcgacattccgaatgtctgccacttcctctgatactttggcgccgtccacatggccgccgcgggttttcgctccttgtgccagctttagctcaaacgctttaatctggtcaatccagctttttcttttaaattcctcccacgaaaattccccgtttcttttgcgtacgccgaataggcccggtccgatttggcaaatgatatcggcgccgccctttaagtgatactcagacaatcctccttcacctgtattcatccaggttccgcctgcctgatgaagcccttttgagagcgccgtaacagcccgttctccaagagaaccgtagctcatggctgactggccgactaagcccttcacataaaatggcttctcgcatgtatgctcgccaatcacctgcacatcatcaggatggagaaagtacgggtctgccttgatatgttcggcatgctccttgcgtttgaacagattgtcagcatccattttatagatttgggtttcaatttttggcgtttgatttacatgcatttcttccctttgttttggaaacatagcgttacggatataatagccaggtttatcaaaatctcttacagatccaaagcccatcattctgcttttgtatttgccggagatgacggtttgctcatattcctttcgagaaaaaggctgctcctcattgtcattgctgtataaatactgcctcagctccggcccgattttttcaaggatataccgaaaccttccgatgacgggatagttgcgaagaattgagtgctcctgctgtttttcatcctttatgtagatccaggcaaacaagacgatcgggatagcgatgatcccaatgataaatgcgatgagtgctattatgatggtttccatctctcagcctccctttttatgtaaccatttccacagtagaacactttccaaacaatagcagaaggaatctggtgaaaatgtgtgcttctgccggtacaggactcaccatgcaggtctgcctcctgctctctttttttatgaaaaaagaatcaaaacacctttttcagtgaataacgagattaacggctttttccgtttttccgcgctatgtgaatttgttataatgtttaaatggtaacaaacgaatggaggaacgtatgacgtgtacgatgtaactgagtggaagcatgtctttaaactcgatccaaataaagatttgcctgacgaacagctggagattctttgcgaatcaggaacggatgcggtcattatcggaggcagtgatggtgtgacagaggataatgtcctgcggatgatgtctaaggtaagacggtttctggtgccgtgtgtccttgaggtatcagcgattgaagcgatcgttcccggctttgacttatattttattccgagtgtattaaacagcaaaaacgcggattggattgtcggaatgcaccagaaagccatgaaggaatacggagaactgatgtctatggaagaaatcgtggcggagggctactgcatcgcaaatccagattgcaaagccgcggcactgactgaagcggacgccgatctgaatatggatgatattgtagcctatgcgcgtgtgtcggagctgctgcaactgccgattttttatttagaatacagcggcgtgcttggagacatagaagctgtcaagaaaacgaaggctgtattggaaacgtcaaccttgttttatggcggcggcatcaaggatgcggaaacggccaagcagtacgcagagcatgcggacgtgatcgttgtaggcaatgcggtgtatgaagattttgacagggctttgaaaacagtagcggctgtgaaaggcgagtagtaaattgtacggatttggtttatgatagaacatatgttttgtataggcgggtgaacaaattttgaattatattagcaatcaattactaagcggtttaaaccccgttcagcaggaagcagtcaaaacaacggacgggcctcttttgctgatggcgggagcgggaagcggaaagacgcgtgtcctgacccatagaattgcttatttaatggcagaaaagcatgtggcgccgtggaacattctggcgatcacatttacaaataaagcggcacgcgaaatgaaagaacgtgtggaaagcatccttggacccggcgcggacgatatctggatttccacattccacagcatgtgcgtgcggatcttgcgcagagatatcgaccggatcgggatcaaccgaaatttctccattcttgatacggcggaccagctttcagtgatcaaggggattttgaaggagcgcaatcttgatccgaagaagtttgacccgagaagcatcctcggcacgatcagcagtgcaaaaaacgaattgaccgaaccggaggaattctctaaagttgctggcggctactacgatcaggtggtcagcgatgtatatgctgattatcagaagaagctattgaaaaaccagtcgctcgattttgacgatttgattatgacgacgattaaactgtttgaccgagtgccggaagtgcttgaattttatcagcgcaaattccagtacattcacgttgatgagtatcaggatacgaacagggcgcaatacatgctcgttaagcagcttgccgagcgtttccagaacctttgcgttgtgggggattctgatcagtcaatctacagatggcgcggcgcggatatcaccaacatcctttcatttgaaaaagattatccgaatgcaagcgtgattttgctagaacaaaactatcgttcaacgaaacggattttgcgcgcggcaaacgaggtcattaaaaacaactctaaccgcaaaccgaaaaatttgtggacggaaaacgatgaaggcatcaaaatttcctattatcgcggtgataatgagttcggtgaaggacagtttgtggccggcaaaattcatcagcttcacagctcaggcaagcggaagctgtctgatatcgccattttataccggacaaacgcgcagtcccgtgtgattgaggaaacgcttctcaaagcgggtttgaactataacattgtcggcggcacaaagttctatgacagaaaagaaattaaagacattcttgcgtacctgcgcctcgtatccaatccggatgacgatatcagtttcacgcgcattgtcaatgtgccgaagcgcggagtcggcgcgacatcacttgaaaaaatcgcttcgtatgcggccataaacggtttgtcatttttccaagcgattcagcaggttgattttatcggcgtcagtgccaaagcggcaaacgcgcttgacagctttagacagatgattgaaaacctgaccaatatgcaggattacttatccattacagagctgacagaagaaattcttgataagacggaatacagagaaatgctgaaggctgagaaatcgatcgaagcccaaagccgtttagaaaatatcgacgagttcctgtctgttacgaaaaactttgaacagaaaagtgaagacaagacactcgttgcgttcctgacagacttggcgttaatcgcagatattgatcagctcgatcagaaggaggaagagtcaggcggcaaggatgcgatcacgctgatgacactgcacgccgcgaaaggactggagttcccggttgttttcttgatggggcttgaagaaggggtcttcccgcacagccgttcactcatggaggaagcggaaatggaagaagaacgccgccttgcgtacgttgggattacaagggcggaacaggagctttatctgaccaatgctaaaatgcgcaccttgtttggccggacaaatatgaacccggaatctcgcttcattgctgaaataccggatgatttattggaaaacctaaatgagaaaaaagaaacaagagcgacgtctgcgagaaaaatgcagccgagacgcggccctgtttcacgcccggtatcctacgccagcaaaacaggcggcgacaccttgaactgggcagtcggagataaggcgggccataaaaaatggggaacaggaactgtcgtcagcgtaaaaggcgaaggagaagggacggagctcgatattgccttcccgagccctgtcggcgtgaaacgcctgttagcagcatttgctcctattgaaaagcagtaattgaagaggaaaggaagaagcagatggacaaagaaacagcgaagcagcgggcagaagaactgcgccgcaccatcaacaagtatagctatgaatattacaccttagatgaaccgagcgtcccagatgccgaatacgacagattgatgcaggagctgattgcgatcgaggatgagcacccagacctcagaacgcctgactctcctacgcagcgcgtcggcggagccgtgcttgaagcgtttcaaaaagtcacccacggcacaccgatgctcagtctgggcaacgcctttaatgctgatgatcttcgtgatttcgaccgccgtgtgcgccaagccgtcggtgacgatgtggcgtataatgtggagctgaaaatagacggtcttgctgtttctctccgttatgaagacggctattttgtcagaggagccacccggggtgacggaacgacgggagaggatatcacggagaatctgaagacgattcgcaatatccccctcaaaatgaaccgtgagctgtcgatcgaagtgcgcggcgaggcgtatatgccgaagcgttcgtttgaagcactcaatgaggaacggattaaaaatgaggaagaaccgttcgctaatccgcgaaatgccgcggccggatcactcaggcagctcgatccgaaaattgcagcgaaacgaaacctcgatatcttcgtctacagtatagcggagcttgacgagatgggtgtagagacgcaaagccaagggcttgattttctcgacgaactcggatttaaaacgaatcaggaacgaaaaaaatgcggcagcatagaagaagtcatagtgctggtcgatgagtttcaggcgaagcgcgctgacctgccgtatgaaatagacggcattgtcattaaagtcgattctctcgatcaacaggaggagctcggttttacggcgaaaagcccgcgctgggccatcgcgtataagtttcctgctgaagaggtcgtgacgaagcttctcgatatcgaattaaatgtcggcagaacgggtgtgatcacgccgaccgcgattcttgagccggtaaaagttgccggcacaacggtctcaagagcatcccttcataacgaagatttaattaaagagaaggacattcggattttggataaggttgtcgtcaaaaaagcgggcgatatcatcccggaagttgtgaatgtcctcgttgaacagcgcacaggagaagaaaaggaattcagcatgccgacggaatgtcctgaatgcggcagtgagctcgtccggatcgaaggagaagtggcgcttcgctgcattaatcctgaatgtccggcgcaaatccgggaagggctgatccatttcgtttcccgcaatgccatgaacattgacgggctcggcgaacgagtgatcacacagctgtttgaggaaaaccttgtccgcaatgtagcagatttatataagctgacgaaggaacgagtcatccagctcgagcgcatgggtgaaaagtccactgaaaacctgatcagctccatccaaaaatcaaaagaaaattcgttagagcgcctgctgtttgggcttggcatccgttttatcggatcaaaggccgcaaagacgcttgccatgcattttgaaagcttggagaacctgaaaaaagcctctaaagaggaacttctcgcggtagatgaaatcggtgaaaaaatggctgatgctgtgatcacctattttcataaagaagaaatgcttgaactcttgaatgaacttcaggagctgggcgtaaacacgctctataaaggcccgaaaaaagtaaaagcagaggacagcgactcttactttgccggtaaaacaattgttctgacaggaaagctggaagagctgtcaagaaacgaagccaaagcgcaaatcgaagcgctgggcggaaagctgactggaagcgtcagcaaaaacacagacttagtcatcgccggagaagcggcgggaagcaagctgacaaaagcacaagagctgaacattgaagtgtggaatgaagaacagttaatgggagagctaaagaaataagaggagtgttttctattgaaaaagacgttggcattggcggcaacggcggcagtattaatgctgtctgcctgctcgtcaggtttcgggggggagaaggaggaagagattacgcaaaagacggcgaaatcgtcagaaaaagcgattgtcccgaaatataatatctctgactcctattacaaaatggtgctgccgtttaaggcaggcaaagcgcgcggcttaacaacggaacagctgaacactaggctggacattgacgagtttgaaacagggctgatgcgtcttgcccaagattctttctcgactgacgattatctgttccaggaaggacaatatttagatgaggatacagtattaagctggctggcacggaaaaaaacgggctctgatttgaaaaaagccgaaaaagaagataaaaacttcaaaaatgaaggcttgaatccagcgctcccgagctctggttcaacagaagaaaagaacgaaagcagcccgatttatttagcatccatgcttgagcacgattatttagtcagaaaagacaagaattctatccagcttggcggcgtcatgatcggactggcgttaaactccgtgtattactatcgtgaaaaaacaggcgatccgcaaaaagaagtggagattagtgaaagcacgcttcgcaaacagggagaaaaaatcgcgcaggaggttattaaccgcctccgtaaaaaagataatttgaagaatgtgccgattaccgtcgcgctctacaagcaggcgtcaaaaacatcgattgtgccggggaacttcatcgccaaaacagaggtcaaagcaggctctactgatatctcaaattgggatgacatcaatgaaaaatatgtattctatccggcggatacaaccacagcagaaaaatacccggatgacaccgaggtctttaagcggtttaaaaattcaattgaagaatatttcccgaactatacaggcgttgtcggtacagcgctgtatgataatgatgaaatgaagaaaatgaagattgacataccaatgcaattctacggaaaaagtgaagttgtcgcgtttacccagttcttaacgggtgaagtgatggactactactctaagagctcagttgatgtcgaagtcaatatcacgtcctcagacggacaggaagcggtcattatccgcaatgctggagataaagagccgactgttcacatttatgactgatagaaaacccttgtgccatattgcacaagggtttttatgttacaattaacaggaaaagggaaattattttcgcttctgccgaaacgcaaatcaaggggaggtatgttgatgctggaaatcgtgtgaaaacaatcattatcaaacctatagcaatgaaaggatgttagacgtgcataaagatatcaaaaaaatatttcatgaagagcaggttttggcagaagctgcagcgaaatacggtttctcaaaagatcaggtgcgttttctggctgatgcggaaaactatgtatatgaatgtatgaaagccaatcaaccttatattttaaagattacccatacgattcgaagatcttctgattatataatgggagagatggaatggctccgtcaccttgcaatagggggaatttcagtagccaaaccgctcccgtcgctgaacggaaaagacgtagaagcagtgccggacggaaacggcgggtcatttttattgagagtgtatgagaaagcgccagggcaaaaagtggatgaatcggactggaatgaaacgctattttatgagcttggcagatacacaggcagcatgcacagcctgacaaaaagttacaaattgagcaatccctctttcaaaagacaggaatgggatgaagaggagcaattaaagctgagaaaatatgtgcctgaagatcagataaaggtgtttcagcaagccgattctttgatgaatgaactgcggaggctcccgaaaagccaggacagctacggcttggtgcatgcggatctgcaccatggcaattttaactgggatcatggcaaaatcacggcatttgattttgatgatatcggctacaactggtttgttaacgatattagcattcttctctacaatgtcctgtggtatccggttgtgccatatgatgataaagctgcgtttacagaagaatttatgacgcattttatgaaagggtactgggaggaaaatgagcttgaccctgcatggctgatgataatacctgatttcctccgtcttcgccatatgctgatttacggattgctgcatcagatgtttgaccttaacacaataggagaagaagaaaaagaaatgctggccggtttcagaagagatatagagaatggcacgccgattacagcatttgatttttcagcactggtgtagatagaaaaagccaatgggattccagtcccattggcttttataatgtatcacacttcacgccgactacgccttcaatggctttaatgtcatagtagacgtcggtcgtgtatctgtttttatggacgcggaccttcacttccataattggaaaatccttttcgcctaggtcgtcgatccgaacggagtgtgctttgatatctcttcttttcatttcttttaaaatctctgtcattttgtctttatcagaaagtgacattctgatgcggatgtctttttcctgcaggcggtcggggccgatttttctgaccacccatgggagaaattccacgctgatcaggatgaacagaagactggcaaacgcttctttataaaaaccggctcccgtagcaagcccgagccccgctgccccccagatcatggccgatgtcgtcaggccggaaatgacatcattgctttttcgcaggatgacaccggctccgataaacccgacgccggagatgatttgtgccggcagacgaagcggatccatcatgatgcggtagtatttagggaaatgatatgccgcattaatactgacgatcgtcagcatgcatgagctgactgcgatgacaatacaggtttttaatccgagcggcttattttttaattcgcgttcaagcccgatgaccatgccaatcaatgtggcaatgcccaatttcaataaaatatcaggatcaatataccagctcaacagcaaacttcccccttctctatggtgtttttaaataaatatgattttctcacagtatttatagcaaaacaagggcacaaaagccaccaagctgcgcttgatggcttattgcttactttttgcgttttaacagcttttccatgacaccgaataatcggtaagaggcttttgcaggacgttttgtgatcatgctgacaatgatgccggcaatcatactgagaataaacccagggatgatttcgtacacaccggttgattttgccaggccggttgtaatccagatcaacacggtcgcagccccgacaatcatggcagcaagcgcgccccattcgttcattcgcttccaatacagactgagcagaatcgcaggcccgaaagctgaaccgaagccggcccaagcgtatccgaccaaatcaagaatggtgctgttcgggttcaatgacaagagtaccgcgataacggcaatgactaagacggacaatcgcccgatcatgaccaattctttatcagaagcttttcgtctgaaaaatgaccggtataaatcctctgttacagcacttgctgtgaccaagagctgtgaggaaatcgaactcatgatggcagccaaaatagctgacaataagaaccctgtaattaatgggtggaacaagattttagagaagataatgaaaatcatctccggatcttttacagcaactccgaatttatgggcgtatgcaacaccgattaaacccgtcagcacggaacctagaactgtaatgatcatccagctcatgccgattcggcgtgcaggcttcaaatctttaatgtttttaatcgccataaatcggacgatgatatgaggctggccgtagtagcccaagccccaggctaaataggaaataatgctaatgacgctcgcgcctttaaaaatatccaataagtgtgggttaacagcgccgatttcatggagagtcggagcaacgccgcccacatgggtaaaagcaacgatcggcacaagcactagtgctgcaaacatgatcgcaccctgcacgaagtcagtcagactgacagcaaggaaaccgccaaacagtgtgtataatacgacaactgcggtggtcagaaacaagcctaatttgtaatccgcaccaaaagcagattcaaacagccgtccgccagataccataccggaagaggtatacaatgtgaaaaagatcatgatgatcaatgcagatacgattttcagcagtgatgaagaatgctggaatcgtttatcaaagaaatcaggaatcgtaatcgcatcatccgccgcttctgtataagcacgcagccttggagccagcagcaagtaatttgagtacgccccgattgtaagacctaaagcaagccataaggtggacagccctgtcgcaaacatcgcgccgggaacacccatcagcatccatccactcatatcggccgcgccggcagacaaagcagtaacgaatggtccgaggcctcttcctccaagcatgtaatcattgatgtcagtggttttcttgaatgcataccagccgattaacagcatggcaataaagtaaattcctaaagatataataatttcaatactcacgttttaccctctcttcatttctaataatgttgcatcacctctcaaattgatggtgccagttaagcagcctggcgtaagtgcaaaacaaaagaaattcttttgcgggtgcacttggtaacttaacctaacaaagtattcccggccattcaagcgatgaaacattgatcataagctggaaataccgttgcaaacatagaagggaataaagaataaaacgctttcaaaaaataattaaagtaaaaatattcagaaaaatatttcgtttctccttcgcctcattttagtataaaatatatagggtattgtttcgaaaacacaggcctgtcttaaggcgttttgttgctttaaagggcttgtttttgatatgatcagtattatatgacttaacggagaaatatgtggaggtggatcatatgtcacgaatttcaatagaagaagtaaagcacgttgcgcaccttgcaagacttgcgattactgaagaagaagcaaaaatgttcactgaacagctcgacagtatcatttcatttgccgaggagcttaatgaggttaacacagacaatgtggagcctacaactcacgtgctgaaaatgaaaaatgtcatgagagaagatgaagcgggtaaaggtcttccggttgaggatgtcatgaaaaatgcgcctgaccataaagacggctatattcgtgtgccatcaattctggactaaaggagggacacaagaatgtcattatttgatcataaaatcacagaattaaaacagctcatacataaaaaagagattaagatttctgatctggttgatgaatcttataaacgcatccaagcggttgatgataaggtacaagcctttttggcattagatgaagaaagagcgcgcgcatacgcgaaggagcttgatgaggcggttgacggccgttctgagcacggtcttcttttcggtatgccgatcggcgtaaaagataatatcgtaacaaaagggctgcgcacaacatgctccagcaaaattctcgaaaactttgatccgatttatgacgctactgtcgttcagcgccttcaagacgctgaagcggtcacaatcggtaaactgaacatggacgaattcgccatggggtcatctactgaaaactctgcttacaagctgacgaaaaacccttggaacctggatacagttcccggcggatcgagcggcggatctgcggctgcggttgctgcgggagaagttccgttttctcttggatctgacacaggcggctccatccgtcagccggcatctttctgtggcgttgtcggtttaaaacctacatacggacgtgtatctcgttacggactggtcgcatttgcgtcctcattagaccaaatcggaccgattacacgtacggttgaggataacgcgtttttacttcaagcgatttccggcgtagacaaaatggactccacgagtgcaaatgtggacgtgcctgattttctttcttcattaactggagacatcaaaggactgaaaatcgccgttccgaaagaataccttggtgaaggtgtcggcaaagaagcgagagaatctgtcttggcagcgctgaaagtccttgaaggtctcggcgctacatgggaagaagtgtctcttccgcacagtaaatacgctcttgcgacatattacctgctgtcatcttctgaagcgtcagcgaaccttgcacgctttgacggcatccgctacggctaccgcacagacaatgcggataacctgatcgacctttacaagcaaacgcgcgctgaaggttttggaaatgaagtcaaacgccgcatcatgcttggaacgtttgctttaagctcaggctactacgatgcgtactacaaaaaagcgcaaaaagtgcgtacgttgattaagaaggatttcgaagacgtatttgaaaaatatgatgttattgttggaccgactacaccgacacctgcgtttaaaatcggtgaaaacacgaaggatccgctcacaatgtacgcaaacgatatcttaacgattccggtcaaccttgccggcgtaccgggaatcagcgtgccatgcggattagcagacggtcttccgctcggcctgcaaatcatcggaaaacactttgatgaaagcactgtataccgcgttgctcatgcatttgaacaagcgacagaccatcataaagcaaaacctgaactgtaaggggtgaaaagaattgaactttgaaacggtaatcggacttgaagtccacgttgagttaaaaacaaaatcaaaaattttctcaagctctccaacgccattcggcgcggaggcgaatacgcagacaagcgttattgacctcggatatccgggcgtcctgcctgttctgaacaaagaagccgttgaattcgcaatgaaagccgctatggcgctcaactgtgagatcgcaacggatacgaagtttgaccgcaaaaactatttctatcctgacaacccgaaagcgtatcagatttctcaatttgataagccaatcggcgaaaacggctggatcgaaattgaagtcggcggaaaaacaaaacgcatcggcatcacgcgccttcaccttgaagaggatgccggaaaactgacacacacaggcgacggctattctcttgttgacttcaaccgccagggaacgccgcttgttgagatcgtatcagagccggatatccgcacgccggaagaagcgtacgcgtatcttgaaaagctgaaatccatcatccaatatacaggcgtttctgactgtaaaatggaagaaggctcacttcgctgtgacgccaatatctctcttcgtccgatcggccaagaggaattcggcacaaaaacggaattgaaaaacttgaactcctttgcgtttgttcaaaaaggccttgagcatgaagaaaaacgccaggagcaggttcttctttccggcggcgtcatccagcaggaaactcgccgttatgatgaagcaacgaagaaaaccattcttatgcgtgtcaaagagggatctgacgactaccgttacttcccagagccggatctagtcgagctctacattgatgatgaatggaaggaacgcgtaaaagcaagcattcctgagcttccggatgagcgccgcaagcgttatatcgaagagcttggcttgcctgcatatgacgcgatggttctgacgctgacaaaagaaatggctgatttcttcgaagaaaccgttcaaaaaggcgctgaagctaaacaagcgtctaactggctgatgggtgaagtgtcagcttacctaaacgcagaacaaaaagagcttgccgatgttgccctgactcctgaaggccttgccggcatgatcaaattgattgaaaaaggaaccatttcttctaagatcgcgaagaaagtgtttaaagagttgattgaaaaaggcggcgacgctgagaagattgtgaaagagaaaggccttgttcagatttctgacgaaggcgtgcttctgaagcttgtcactgaggcgcttgacaacaatcctcaatcaatcgaagactttaaaaacggaaaagaccgcgcgatcggcttcctagtcggacagattatgaaagcgtccaaaggacaagccaacccgccgatggtcaacaaaattctgcttgaagaaattaaaaaacgctaataaaaaaagcagcccttagaggctgctttttttatggtcaaattgagataaagacagagatgagggcccgaagcctttcaacttctttgtcgttggttccggtcaaattggacagcatgcctttaataatcggcttgcgcggtttatcctgagtcaattcttcctcgataacatcaagtgacacggtgatatcctcgggcagcgtgctgttttctttcactttctgaatgtcctcaagcagctggtctttctccgcaggcatcgggttgaaaatgtcttttgacacaatcggattgagtgcagaacggctcagtccctgtacaagatcatccagtctctcaataataaaggctgagatttcttctgcatcgatattaagctcaccgttaaataccatcacgttcatataggaatgcacaatgcctctagccatgatggacagatctgcgacataccgctcgattccttcgccataggataccagcaaggcgttccggtacagcttatccgtctctgtggtaattttgtaaaaatattgcttgatttcttggttttccggaatgatattttcggtaagcaaaagaacgataaaatctttatgatcacgaaaatcctcaaattgtgcgccaatttgttttttcaaaacttctttaggcggctttccggcgagatcttcttctatatttttcattttgttcatagacataccgatataatattcacaggcagataacagcagcgcttctttcgatttgaagtgcaaataaaaagcgcccttcgaaatgccgcattcactggcgatttcttggatcgtcgtagctgcgaatccttttttcgcaaataaacgaatgctggtttttataattctctcttttttttcattcatgacgtgcttccccttaatccttgaaaaatttagtaaaattttctggtatatgagttgacgttgttgcgttataacgtttagtattatatagaatgaccagtcagtcaataaaaaatgtaatggaggatatgatgaatcacgttattaatttcgttctgaaaaacaaattcgccgtatggctgatgacgattattgtaacggcagccggcttgtatgcgggtatgaatatgaagcaagagtctattcctgacgtgaacatgccttacttgacgatcagcacgacatatccgggtgcgacaccaagccaagtggctgatgaagtgaccaaaccggttgaacaagccgtgcagaacttggacggtgtcagtgttgtgacttcgacgtcctatgaaaacgcatcgtcggtcatgattgaatatgattatgagaaagatatggacaaagcgaaaacagaagcagctgaagcgttagaaaacgtcaacctgcctgatgacgcgaaggatccggagatttcacgctacagcttgaattcattcccgattctgacgctgagcgtgtccagtgataaagataatctgcaagagctgacgaaacaagtggaggacagcctcgtttctaagcttgaaggcatagaaggtgttgcgtccgtccaagtatcaggccagcaggtggaagaggttgaattctctttcaaagaagacaaactgaaggaatacggccttgatgaagatacagtcaagcaagtgattcaaggttcagatgtgacaactccgcttggattgtacacattcggaaatgaagaaaaatctgtcgtcgtcagcggcgatattgaaacaattaaagatttgaagaatatgagaatcccgacggcatcagcttcaagtgcaggcagcagtgcagcatctcaagcggcggcgcagagtgctcaagcagctcagagcgcgcaagcggcagcacaggcgcagcaaagcgcaagcacagcagtgccgacggtcaaactttctgacattgctacaattaaagatgtgaaaaaagctgaatccgtttcacgcacaaatggcaaagacagcatcggcatcaacatcgtcaaagcaaacgatgcgaatacggtagaggttgccgacgatgtcaaagctgagctgaagaagttcaaagaagaccataaaggcttcaattacagcgcaactctcgacatggcggagccgatcacacagtcagttgacacgatgttaagcaaagccattttcggtgctatttttgcgattgtgattattctcttattcttaagggatatcaaatcaacattaatttcggtaatttcaattccattatcattgctgatcgcactccttgtgctgcagcagcttgatatcacattgaatattatgacgctcggcgcaatgaccgttgccatcggacgtgtagtcgatgactccatcgttgtgatcgagaacatttatcgccgaatgagactcaaagacgagccgctccgcggaaaagccttggttcgtgaagcgacgaaggaaatgtttaaaccgatcatgtcatcaacgattgtgacaattgcggtattcctgccgctcgcacttgtaggcggacaaatcggtgagttgtttattccgtttgccttaacgattgtttttgcgcttgccgcatccctggtgatttcaatcacgcttgtgccgatgctcgcacacagcctgttcaaaaaatcattaaccggtgcgccgattaaagcgaaagaacacaaacctggcagacttgcaaacatctataaaaaagtattgaactgggcgctgagccacaaatggatcacgtctatcatcgctgttctgatgctccttggaagcttgttcctcgtaccgttaatcggtgccagctacctgccgtccgaggaagaaaaaacaatgcagctcacatacagcccagaaccgggtgaaacgaaaaaagaagccgaaaatgaagctgaaaaagcagaaaaaatcctgcttgaccgcaagcatgtcgatacggttcagtattcattaggctctggcagcccgcttgccggaggagattctaacggtgcgttattctatatcaaatatgaaagcgacacacctgactttgataaagaaaaagataacgttctgaaggaaatccaaaagcaatctgaccgcggagaatggaagtcacaggacttcagctcttcaggcaataacaacgaattaacatactatgtgtatggcgattctgaaaacgatattaaagacacggtcaaagacattgaaaaaatcatgaaagatgaaaaggatctgaaaaacgtaaattcaggcctttccagcacatatgatgagtacacatttgtcgctgaccaagaaaaactaagcaagctcggtttaaccgcgtctcaaatttctcaggccttaatgtcacaaacatcgcaagaaccgctcaccacagtgaaaaaagacggcaaagagcttgatgtgaacattaagacagaaaaagacgagtataagagtgtgaaagatttagagaataaaaagatcacttcagcgactggccaggaagtcaaaatcggcgatgtggcaaaagtgaaggaaggatcaacatcagataccgtgtcaaaacgtgacggaaaagtctatgcggatgtcacaggtgaggttacatctgacaacgtcacagccgtatcagctgctatccagaagaaaatcgataagcttgaccatcctgataacgtatcgattgacacaggcggcgtatcagcggatatcgctgattctttcacgaagctcggtttagctatgctggcagcaatagcgatcgtttaccttgtgctcgtgattaccttcggcggagcactagcgccatttgcgattctgttctcattgccgttcacagtcatcggtgccctggtcggactttacgtatcaggtgaaacgatcagtctgaacgcaatgatcggtatgctcatgctgatcggtatcgttgtcacgaatgccattgtcttaattgaccgcgtgattcataaggaagcggaagggctgtctacgagagaagcgctcctggaagccggctctacacgactccgtccgatcctgatgacagccattgcgacaatcggcgccttgattccattagccctcggcttcgaaggcggaagccaggtcatttcaaaaggactcggcgtaacggttatcggcggtttaatcagttcaacacttctgacactcttgatcgtgccaatcgtatatgaagtattggcgaagttccgcaagaaaaaacctggaacggaagaagagtaaaaaaacaaaaagcctcagctctgctgaggcttttgtgcgttttcacctgtaagattatgtacattttgttgcgatttttttaactcatagtataattaaaggttgttagtgtaaaaatggatcggatactcttaagtaggatgatgagataatgaaacgtgcacgcataatatacaatccgacttcaggacgggagatctttaaaaagcatcttgcccaggtcctgcaaaaatttgaacaagccggctatgaaacctccacccatgcgacgacatgcgcaggagacgctacacacgctgccaaggaagcggcattgcgtgagtttgacctgatcattgcggcaggcggagacggaacgatcaacgaggtcgtcaacgggcttgcgcctttagacaaccgtccgacactcggtgtcattccagtcggcacaacaaacgacttcgccagagcgctcggcattccgcgagaggatattttaaaagcggcagatacggtcattaacggcgttgcccgcccgattgatatcggacaggtcaacggccagtattttatcaatatcgccggaggaggccgtctgacggagctgacgtacgacgtgccaagcaaactcaaaacaatgctaggccagcttgcttattatttaaaaggaatggaaatgctgccttcacttcgtccgacagaagtcgagattgaatatgatggcaagctgtttcaaggtgaaatcatgctgtttttggtcacgctgacaaactccgtcggcgggttcgaaaaactcgcgccggattccagcctgaatgacggcatgtttgatttgatgatactaaagaaagcaaaccttgctgaatttatcagggtcgctacgatggcgcttcgcggcgaacacatcaacgaccagcacattatttatacaaaagcgaaccgcgtgaaagtcaatgtatcagaaaagatgcagctgaacctggacggcgagtacggcggcatgctgccgggcgaattcgtgaatctgtatcgacacattcacgtcgtcatgccgaaggagaaagcggaacagctggatgactaaaacttggctttgtaagccaagctcagaatgttgacaaaatcctaaaacagttttcgttttaggattttgtcatcttttcagcgtgattgaaaacctttgaagtctaggaaggacgagcattggagcggagcgaatgttgaattcgtgagcaccgaagcacaggactgacaacgaatgcgaaggtttgcctacacgctgaaacttggcttgaacaggccaagtttttctttcgcttaaaactagaggtgattatagatgaaaatgaaacccccagtagaaaaaaacgaatactatgacgtgacttttgaggatttgacccacgaaggagcgggtgtcgcaaaggtccaaggctttccgatcttcgtgccgaacgccctgccggaggaaaaagcccaaatcaaagtgacacgcgtcaaaaaagggttcgccttcggccgcctgattgagctgaaggaagaaagcccgcatagaacggacgccccatgcccgatttacaagcaatgcggaggctgccagcttcagcacatgacctacgaaggccagctcctgtttaaacagaaacaagtcaaagacgtcttagaacgcatcggcaagctggacctttcaaacgtcaccgtgcatccgacactcggcatggaagacccgtggaactacagaaacaaagcacaggtgccggtaggagaacgggaaggcggactcgtcgcgggattctatcagcaaagaagccatgacatcatcgacatgagcgcctgcctgatccagcaatccaaaaacgacgaagccgtccaagccgtcaaagacatttgcgcaaactacggtgtcaaagcctacaacgaagaacgccacaaaggctggctccgccacatcatggtcagatacggcgttgttacgggcgaaatgatgatcgttttcatcacaagaacaaacgatttcccgcataaagcgaagatcatcgaagacatcacagcgcaattcccgcacgtcaaatccatcgtgcaaaacatcaacccaaacaaaacaaacgtcatttttggcaacgaaacaaatgtcatctggggcgaagaatacatctacgacctcatcggagacgtaaaattcgccatctccgccagatcgttctaccaagtcaacccagagcagacaaaggtgctctacgacaaagcgcttgagtacgctgagcttcaaggggaagaaaccgtcattgacgcttactgcggcatcggaacgatttctctcttcctggcaaagcaggcgaaaaaagtgtacggcgtagaaattgtaccggaggcaattgaggatgccaaacgcaacgctgaattaaacggcatcacaaacgcagagttcgcggtcggggaagcggaaaccgtgattccaaagtggtatgaagaaggcatcacggccgatacgctagtcgtcgacccgccaagaaaaggctgcgacgaagccctcctgcggacgattgtggagatgaaaccgaagcgggtggtgtatgtgtcctgtaatcctggcacgcttgcgagggatttgcgggtgcttgaggatggcgggtatcagacgctcgaagtgcagcctgtggatatgtttccacatacgaatcatgtggagtgctgtgtgttgctcgtgaaaaaatagaagatatataagggtccgagaatcggtaatgggttctcggactcccatcttctattatttcaattctttctatgactgacaaattagatcttggattttgaattgagggtaatattcctcatagaatttcttgaattcattatacagctctgtgttcattttgaatctgggcttcatacttagcttccttattgtaaatcctctcatcaagcatcaacattctattgaattggtacatttagagaaaaccttttaaagcatcaaagtgttcgggtaatactggcttgtccgactggtgataaaaataatcatccactttcatttctttcgtgaaatttgctgtatagaatacctaccatacctgctactttcttcaaatcacttttatatagaaggttcacttctacactttttgatggtttcgttgtaaagaatgtgtctttatccacaagcacaaccctctttctatttgtgaggatatagtagaagttagagcctatgattccatgagggattcggttttgattcaatatattggaaatgtatattttgaataggtagaatatagatggtaagtaatattcggcaagtaattgtcccttttaaaacacacctatttgtaactgcgtcatatgtagtttaacgttagtaaagtgaatttcattcgaagtctaattaaggagaaggtaataaatgatgaacccactagactcatcactttttctaaatagttatagtgttccatacaatggatttgaaaataacaatttggttttatcgatgttatattccaaagatactgtcattttgcattatttggttcttaaacaaaaaaacaaagaaaaatttatgatatgcggttttgatttcattagcgggtcaattattcctgtagagattacgaatataggtagcgttcttagaaatcttagggatttcttaaatagtgaatataacactatgaatatagttattgagtctattgacgaaattgtagaacattttgagaatgggaaaataaaaaaagaaattgatacatataagtctttatcaattctgacatcaacacagagaaatataataagtgggagctgtgaggtatacagtaacggtaaattaattagacctcataaaactttacttatatcgagtagaagaggtttagtttacgggaaatttgaatttgaaagtaatcaaaatgttattcagggtttgaaaaatatacacctttctgaggattgggttatcaggtattggataaatgataattctatagaatctgcagggacaatatatgaagtgaaaaaaggtatagatggaatcacaatttttctaagctcatttattcatgaattaagtaagaagaagatggatttcttttcttttcaaggttcagacccaaattcaccattacaggcgatattgaggagttccggaatgttaaaggaacaaattaatatagagggttttggagtaaaatttgttccttaccttgtgttgcttccaatagaaaatctaatgctaaataattttgaatttgggttggggggtgtaacctttttaactaaagaccaagcctttgatatgtataagggatttgaggagaaatataatcataatttacttggtcagtttgatacttttgctcaaacaattgtcgaatcagataacgtatatgatgcctatttattaggtagacaaaaagttcaagatgcaatcgatatgataattttactatccaaaaatgaaagagtgtttaatttatacaacttaggtaatgagctaaatgaatggaatagattaagattatatcaaaatcctaaatgctcttcactctattatgtggaaaatctagtaggcgtagaaaacattttgggtgattctaaaaacacctgggaaaataattctttaggtgtcgattctcaatttgaaaaagtttttagagaattggattggtatgaagaaaaactgtacaaaaaacagaccgggcagcaatcaactttagacaagcagttgtttaatgctttaaagtggttgaatagaagttggaaagcagaagatatagaagacaaggttatttatacaaacatagctatggaatttttggttgataaaattgaaaccgacccttttttgcctgatgaaattattagggaattcaaaaaattgttgaagcaactattaaaagaacaaagtgatacttttacagaagaatattctaggaaaataaaagaaaagagtttaggaaaacttaaagatcctcctttgaaaatcaaagttcaaaccttgattcggcatctatctattccaataactgatgaagactttagtaagttatggaaggttagagactatcgtaatgacctggtgcatggaagggatgaattaaaaataaacccagaaaacgttttgagtgcaaatatacttttaggagagttaattgtttatagattaagaagtatggaagaaggtgattgatataaacactttattagccgcctatcattttggaaataaaatatcaaaatccccttttggaaggacacttttcctaagatttaatgacataaagatcaaattatcaccggaagcatggtcactctatcacgatgcgattaagacatgtttatttcaacactattatagttttggacttgcctataaaaaaattgaggctatatgttcaaaaaaagagggatatcttcaaaaaagttttactgaattacaagattgtagcgaggtgcatttattaattgaggagggagatcaactcggcagagatttggaaaattcactttttcaaatgtttgcaaggctaccttcaaagaatatttctggaacctttaattcttttgatttatatagagcttggatgaatgttttttaccaattgcaaagcaccaaattattaacttacctacatcaacataaatcaaatatagaaaataaacaaggtaatgttcaaaaatttatggagtcaaaagaggtttatcctttctcaagacagaacagaatacttattcgaaaattagatataaagggtacacataaggagatcatgtattctttggaattttttgatgggcttagaaattccattctccaagttatttttgaaacccattttaatcgctcttttacactaaataaaaatgagatagttgaatacaaagaaaagaaacgaaataaagttcgtgttttttcgacaaaggtatttggcacggatgtttttaaatataaaggaaattttgtattgctatatgaaaacaataaactacaagaagtcggtttgataaagagaagagtaggaagaaacctggaaatgggtgataaatctatttcaacaattgagggcctattatatccaaaaaacgattacaatctttttgtaccagagctcacaaattaatttaagaacctttctggaacagtaagaaagtatggggtgttaatactacatcatcccttaactttttcttgattgataaaatcctcttcacgctttaatcgtttttactatataaattgttatggaaatatagatgaattcccactgctcaatattgttttgaatctactattcagcactctgcgcatcaggagtgtgtggcggttctgggaattagaaaaggcaactaacctctttgttagtgttgccttttttaaattggaaaaggcttatgtttccatgttttgaataactaatttcgggtatattcctttcaagtgagttcatccttctgtggatttcgatcagaagtctatcaacatcttgaacacggttaggatcaatatatttactcttctttagaagcttgtccatgtcggttaataacagagacaaatcatttagattgtcttgttgttcttcgaattcaacagaaagtacatttgtttgaccgtagctatttattttttcttagaggtttacaatttctcttaattggttttacattacttccacctatcttgtttttttatgcttttgtttggtctgcatatgaaagtttgaacataaacattctatcaccttgtcacctatctcttcagaaaaagagacacagcctaagctgcgtcttgtccttaatcaagcgttccgttttctgcaatcgtcatttccttgtcaaagatggctttgtctgctagggagttcgttgaatcgtttgcagctttgcttgtcatgtttctggatgctacgtttacttcatttcccaaggaagaactgataaagcttacaccgatcaaagcaattacagcgcacaaagtcagtttaaatttcatacaaacaatcccctctctgaatttgtttgcgggcatgaaccatctttttgaaacagataacagaatcatccatctgcccaatttcagtataaaactttgcggctaataatgccaactcttccatataaggatatccttgggatgtctctaatttgttgaaaacatttaataaaatggacgcttctccttttttgataaacagcgcctgcaatccttcaaacataattttaaatagattatcgtcgaatttacatgcgaagcgtacgccttttctgaaacaatccattgcctggtcttgtttatgttgaagaaaataaattaaggctaaatcgtggtaagcttgtgtcaagttgttgaaatttgattttttgaattggagaatcgatttctccatgtattttgctgctttcgtcaattcgcccattttaagataacaatttccgatattgaataaagcttggccgtaaatccgcttgtttttgctttcaagaagccgtgcgccttttagtgcctgttcaaggtgagggagcgccttttcatgactttctaaatcgtcgtagtttcctgcgatcacaaaatggcattgtatgcggcggactgagtaaaggtcgtgtgttttatagatgttatacgcctgagaagaatagtgcatggatacgtgggtttgtttcatatgataaaacacttcagccattttaaaataaaattccgcccgctcaatttcatctgaaatatagggaatggtgttttccgctttttgatagaatgtaatggcacttaagaaattgccctctttgaattcatacatcccttgaaaaaagtaatagtagtattcaacgagtttctccatcttcctgttgctgccttcaattctctttaaatattctgataactccatttggtttccttcagatggaatcacatagtcaatcataagctgatggcgaaatgcaatgagctgatagtaaatcaagaggtcttggtcttcttccatgatgtcaatgtcccgttcgatctcagctttaagcatttcagcatctgtcacattaaacttttgaatatgccggttccactcattaattttcatcccaacgtgcggagacgaaatcgtgcccaaacttctcacccttcctcttctcactaattatgtaaattttatcaatacagaaatttaataggaaggggttgagagaccgcaaaaaaagttttcggtgctgtccgcaaaagggagtttgggtgttttggtgttatatttggttttgtgtgggttagtgcaatctcaatttttgaattttagattgcggtgattatgacttaccagtttcatcatactttttaagagcttttcagttttatgtatttctctgagcatgggattcatgtagtcgctagctgattctaggtatgctcttgtcaaagtgtctagtttatttctaactttagagaggtcttcttcgaattgttcctctgttgaatgtttgataaattcttttgcctcttcatatctttttaatatgtttttcaccattggagttggattcttttgatttattgtttttattacagtgattgttaaattatttgttttattaattcttttcttactgtcaaggtgatgctccttttataaagtgagatgagataaaaataaagccctcaagtaagagggcttcatatttatttagaattttttacttaaacatagggtactgcaccaataaatttaaatgaatagtttttatcgtttatttctttctccctgccgtcatattcaaaattatataaaagaacagcagcattgatgtgttcaggaattgcggtacctactatgttctcaaatcgaggtaagatgacactatcgtacgaacagccgccaattagttcagataaattattgcaatttttttcatgtgcaactttttctataaaatcttcatctaattcatcgatatctatatcaaaatcaattaaaaattgggaagggagaaaatcaccttcatcctcattgtaatctaattcaacatatttacttaatgattcatcatcatttatacttccaatccacaatgatacgaaattttgacgttccatattaacctcccattatttagtccttaatccttctggcagtgctgccgctccaccttttagcctatagttcgcccaattatttaatcttcggacaaacatattatagtttaaggatgaatcaataattcctagcaattcattatgagcagcggttgaacccaatcctccgtgtttaccaactggattcacaaactcgactttgtttatggcagttcttaaatctctaatttgttcagctgtaactccccaatgtttgaaagtaggggccctagaaactaaatgccattcgtgcatgccgccgggtgctctcaattgtctttcaattgctcttctaactttcttatctgtccaaagctcatcaagttgcttcgttgttaatgagttgaaccaattattaaattcaccactttttactgtaggaattattgtttttctaggtttctttatgttctgtgtttttctttcagttttttgcaatgcatttgatttctgttcttcaatttcttttttcagaagcgatgtattctttacattatgcgtattctcaatatcctgagcaatccctgcaaaagcgacttgatttttaccttttaaagcactgctgaaatcttttgttttctggattcctgtctttacatgtttagtagtagctttttctccagcttcaagcactttatcgactttggcagcacctgctttaccaagtttacttgttactttcacaacagagccagcaccttttagtccgacgaggctcccgaccacataggtaatataatgagatcgtgagtatgcatcaccgttaaccattttatcattccatgaatctgctatgtttgtccatatgatttttgcataggaaggtgtcttcaatacagttgaaattgttttggctaatttttgttcttcggagagctgggaaaactcccacgctccgacagctaaatctttaacaccagtcacagtatccttagcgacatcgtagagaccgactccaactcctttcagaacttcccatgtggtttcaccaacttcttcgagctgttttgcttgctcaagctgcaccacatactgtaactgtgcaggctcaaggttctcatacccaatcttcttcgcaatttctaaatattcatcagggtcagataccccatccgcaagctttttcttcagtttttcaatctcgcgttccttcgcttcctcttttttaatcttcaagtaagcctcagtccgcttttcaatgtcgccttttttcttatgtatgtcgctctcacggtaagccttggcgttgtagtggatgggtgtggcgtttttgcctttgcccgttgcttcttggagcttttggaagtcggatttgatgaattgttcgtttggttcagacagggcgtattctgttttcaggtcttcgtccaaggcgtccaatttttccagtgtttttttgcgtttgtcgttggcatcggccagctcgtctttgaaggtttcggttgaaaacaggtcgagcgggaggatgtcgtcgatatcgtttaagatgtctttcatcgcttttttctgttcggacatgatagattttgattttttatttgcatttgccagttcgtgctccagaaaggattcttcgatgtatgcgtctgagaggcctttgtcctcggcggctccggcgatgctgttgaaaaatgcgattttcatatcgatgtagtcgatccactggtcggtgacgccgacgtggtcgtgatagaaggctttgatgttgctggcgccttttcctgaaaattcgctgtcactgagatcagcgacgctttttaacgcttttctcaaatttaccatttgcgttcttagttctttgtactcttttgcacggtctgtcgcttccgaaagcagtgttttcgcttcaaatactttcatgaccatttcccttcttttgttcactcaatatcaaaattttaccacggggcgggatgagggtgggggtgagaacgtgttttggtggaaaaatgagtcatttggcatgtgtctaagtgcatggttttgataagatgatgatagatcaataaaaaggggaagagctcatttgggtaaagatttcttaatcataaagatcaaggatattcaaaaaggcgacacgctaacgaaccgcgcttgcgggaactgggatatgaaattgtccagagcaaaggaatgtaaacgggcaattgttgttcggagcggtgtgattttaaatgtttacaagatcgttgacgcttgggaatctgaagaacccgccaagatcactaaaacgaataatagagtccggtttcaattggcagagtgccgtgactattcttatttaattggaagtacactgaaaacaaaaacgcaaaatccggtttcgagtctatccttagaaaccttaatggaactagtaaaataaaaggagcccagcatgtatctctataaagtaaacaaccaaaatcagctagaagatattcgcgagaaaccgtttaaaaaagaaaaagagattcaggatttatttgagaccaatcttcagcaaatgttggggctcagttttgtgaaatctgaattcaggattagcaatttccgcattgatacgttagcgtttgatgctgagacgaaatcttttgtgattatcgagtataaaaatacgaagaacttcagtgttgttgaccagggctacgcctatttagcggcaatgctcaatcataaagctgatttcattcttgagtacaatgagaatcatgatcgtccgttaaagcgggatgatgtggattggtcgcagtcgaaggtcatttttatttcacctgtttttacggtgtatcaaaagcaatccatccattttaaagacctgccaattgaattatgggagattaaaaggtacgaaaatgatctgatccagttgaatcaaatgaaggctgatggcgtctccgagtcgattaagaccatttcgcagcaaagtgagaccattcaagaggtcagcaaagaaattaaagtgttttctgaagaggatcatcttgcagataaaccgtttgacatcatagagctttatcagcagctaaaggaattcatttttaatttggacgatcatatttcaatcaaaccgacaaagctttatattgcgtttacatcaaataagcgaaatttcactgacattcttcttttaaaaagcggacttaagctgtgggtgaatatgaaaaagggagaattgcatgatcccgagaagagaatgcgcgatgtctctaagaccggccactggggaaatggcgactatgagattttcataaaagatgacgaaaacatagaatatatcatgggattgatcaaacaatcctatgagaaaaataagtgagaacttccatggagaagttcttttttttattggattacaagggatatgtacagggcatgttgaaaacgatatagagtttttaaccatttactgggagtttcttgtgtgaaaaagcgttttatactattgggcttgttcgcaagtgtttttatgttgactgtgtatatttccattcaaaataaaaatacgcatcctgtccaatcttccaccatccaccccgaagaagaccgcatcttttttatctactccaatcctttcataaaagaaagcacgctgctttcaacctctacaggcgaacggtttaacaggcgcacgtttaaggtggcggatgttccttatattcaaatgaagtcatacaaatccacagaccttgtattattggcggaacacgagcctttttactacacgctggagaaggatgtgatcaaagagcatccgctgtcagatccatttgcgttttggtatgaggggaaggatgtgtctgttaaggcctataatgttgatacgacgggaaatgagatccacataaacgacagaaaaacgaaaaaggaatatacccttaccttgccttcgcttgtcacgatgggggccagtgatgagaactatatttatatcattcaaagcatgtctatttacgtgattgacagaaaaacagaggaaatgattgagaccctgagcttagcctcatacgctgatcaattcgcagactcgaaggaatttattgttgcgagctcggagcatgaattgactgtgattgaaaaagggacatggaaaacgacatatattccgtatcctgatgatcttgaatacgctgataccgtatactatgacaaagaaagcggaagtttttacgttacgtacgaagacaaagagggtgaggcgaacttgctggagtatgggaaggaattttcttttcatacatatagtttgaatttcccttatatggaagcgaagtttaaggggaatctattgtatatagttgcccaggaagagcataaaaagggcatcggcggatacgtgggtgtgtttgatatccattctaaggagatgctttatcagtttgatttgcctgaggaacaggtgaaggttcaggattttgttgtggttgattaaagtgaaagctcttagcgtctttttcttttttgttcaagagttgatctttgctgataacagtgtcgaaattctatgaaactttcattcaaagtacgcgtatatgaaccaaaaggaggacgatgaagcaatgggtggttcatatttgagtgatttgtgttcaatgtatcaaaaagataagttctttaccggatttgtccctgaggagcttttgacatatgcgtgtgagttattcccgttatcgaagaaagaaacggtgacggccttactgaattgttccatgggaagtaaagcgaaaagctttgttatgtttacgagtaagggattgtactggaagagatttggagaacaagagggatgtgtgacttggggagcattcactgatatccaatcgattaaatcgatggatgattatgagatttggtttgatggagtagaggtttttgatgtcggcttcagttcatatcctgcggatctgttggcagagctgttgaggataattcagcaatttcttagtgaaaatgacttggatttgcttacggaaccccagatagatcatgtatctgtttctgccagtgaattgagggaaatcagtattttgtttcagaacagccatgacaagatgttcggtttgaccaatgggctactggtcggtaacgagatttctgaaaagagagaggtacgattgagaaaacggctgcatattcctaaggatcaggagatgatctccttctggagtacttttcccgtgaagcaaacagatggcatcacattaacagacaaagggatttatttttcagatccttttctcaggttattttatccttggcatgtgtttaaggaaacgcctgtaatgttaaaagatcaggagttaattgtggggaaaaagaatgtcattcaattgctggaaaacctgatgcctgctaaggacgtatttgcttttttagaacaagtaaaacgaagaatcagcgctgttacgagctggtgaatacgtatttgaaataagattgacatgggacccttgcataaagggttcttttttatgaaaaaaacaaattgacaggatgaaaaaacaatttcttccttctgtattgttttcaaaatttgggattgatagaatatgacatatctcatagagaaggagggaagccgttgagtcaagccataccgtcttcgcgtgtaggtgttaagattaatgaatggtataaaatgattcgccagttcagtgttccggatgctgagattctgaaagcggaggtggagcaggacattcagcaaatggaagaagaccaggatttgctgatctattattctctgatgtgttttcggcaccagctgatgcttgattatttggagccgggacaaacatacgggaatcgccctacagtgacagagcttcttgaaacgattgagacccctcagaaaaaactcacaggccttttgaaatactactctttgtttttccgcggcatgtatgaatttgaccaaaaagaatatgtggaagcgatcggatattatcgcgaggcggagaaagaactgccgtttgtgtcagatgatattgagaaagccgaattccattttaaagtggcagaagcgtattatcacatgaagcaaacccatgtgtcgatgcatcatattcttcaagccttggacatttatcaaaaccatcctctatacagcattagaacgatacaaagcttgtttgtgatcgccggcaactatgatgatttcaaacattatgataaagcgctcccgcatttagaggcggcgctggaattggcaatggacattcaaaatgacaggtttatcgccatttctctattgaacattgcaaacagctatgacagatcaggagacgatcagatggctgtagaacatttccaaaaagcggcgaaagtaagcagagagaaagtgcctgatctgcttccgaaagtcttgtttggattaagctggacattatgtaaagcgggccaaacacagaaggcgtttcagttcatagaggaaggattagaccatatcacagcacgttctcacaaattttataaagaattgtttctgttcttgcaggccgtgtacaaggagactgttgatgaacgaaaaattcatgatcttttaagctatttcgaaaaaaagaacctgcacgcttacattgaagcatgtgcccggagtgctgccgctgtttttgaaagcagctgtcactttgaacaagccgctgcgttttatcggaaagtgctgaaagcccaagaagatattctaaaaggagagtgtttatatgcctattaagaaaaaagtgatgatgtgcctggctgttactctattattgggaagcatgtcgtttccaaccctgacaaactccggcggatttaaggaatcaacagatcgaaatacgacgtatatcgatcattccccttacaaactcagtgatcagaagaaagcccttagctagggctttttcttgctttacggaagacgttccattttccacatcgcggcattccttctatttctaacgcaagacactcgaaacaaccaaaccatttgaggtataatggataaagtgaataacagtatttagattgatatatatgaaagagagtggaacatcatgggccgtaagtggaacaatattaaagagaagaaggcgtctaaggacgcaaatacgagtcggatttatgcgaagtttggccgtgagatttatgtggcggcgaaacagggcgagcctgatccggaatccaaccaggcactgaaggttgtgcttgagcgtgcgaagacttacagcgtgccgaaaaacatcattgaacgtgcgatcgagaaggcgaagggcggagcggaagagaattacgatgagcttcgttatgagggcttcgggccgaacggatcaatgattatcgttgatgcgctgacgaataatgtaaaccgtacggcgccggaagtgcgtgcggcgttcgggaaaaacggcggaaacatgggtgtgagcggatctgttgcttacatgtttgacgcgacggctgtaatcggtgtggaaggcaaaacggctgacgaagcgcttgaaatcctgatggaagcggatgttgatgtacgtgacattttagaagaggatgacagcgcgatcgtgtatgccgagcctgatcaattccatgcggtgcaagaggcgtttaaaaacgcgggtgtcgaggaatttacagtagcggagctgacaatgcttgcgcaaagtgaagtaacgcttccggatgatgcaaaggaacagtttgaaaaattgattgatgcattagaagatttggaagatgttcagcaggtatatcataacgttgatttaggtgagtaaggagtgagcaggctgttatggcctgctttttttgtcccggaaattgttttagctgtatgtaggcggccgcctatacgatctataagatattctcatactctggactgtaacctatgtgaaggagagagtgaatatgactgatacaagacatatgtatggcggacctggttttggtcattatcagggctttggtattggccacccgggctatggcatgcaaagcacaggctatccgggctatggcatgtatggaggccacccgggctatggcatgcaaggctacccagatcacggcatacatggaggagtcggcggctatccgggatatggtgggtacggcggttacccaagcggcggctatggaggctctccgggagctggaagctatccgaacatgcaccatgaaaatgatggccatcaccactattatcaccatcatcaccatgttggaaaggataatcatcaccaccatcatgatggtcattatggccaccatcaccaccatatgggccactggggaaaagacggttataaataaagaagatgatgataaaaagaggacactcttgcagatcaagagtgtttttttagcttttttcttgactattcagtctggaaactggtaacatttgtttcaggaggtgatagtcttttggggaggaataaagaatttgatacggcgcttgttcttcacagggcgatagaggtttttggagagtatggctacgaaggaacgtctcttcaggatctgctctctcatttaggcattgcgcgccaaagtttgtatgatacgtatggcacgaagcgtgatttgtttttgtccgctgtgaaaacgtatcttgaagggaaaaacactgccgttatggaaaggcttgaagcgccaggatctgtaaaggaagccattcgtaatatttttcaagagggtgtcaatgctttgagggatcctgaacgggcgaaggcgtgctatatcattaacagcgcgattgaacagattccgcatgaccctgagcttgcccggtattttgacagacaatccaagcagcttgaggaagctttttatcaggcgcttttaagggcgaaggatcaaggagaattgaatggcgaagatactgatatatctgcgcttgcccggtacctgaatcaaagcaggctgtctctgacatttgttgcgaaagtgacgtctgatatagatcggcttcaggaccatgttgacgtgagtttatcagtgcttgattaacatgtggtaaaggattctttgcccatgtatgtactttttggactgaatagtctagaaataaaaatgaggtgatgatgaatgttgatgaatgagtttgaaaaagcatgtgaaacattgagaaagtttatggcttatatgcttgagaaggacatgaagagctggacggagctttgggatgagaatgctgtatttgagtttccttatgcgccggagggatcaccaaaaagaatagaaggaaaagcggccatttacgattatattaaggattatcctaagcagatccatctttcttcatttaccgctccgacagtgtaccgttcagcagatacgaatacggtgattgcggagtttcaatgtgacggccatgtgattgagactggactgccttatcgccaaagctatatcagtgtcatcgaaacgagagacggccgtattgtgcgatatagggattattggaatccgcttgttgtaaaagaggcctttggaggatcatttttgcaaacagaggagagtgggaaatgatgaaacagaatccgattttaatcacgggcgggaccggcacagtcggcagccgaatcgccagccgtttaataaagctgggacacagggtgcgtattgcgagccggaaaaagggcgcgcttgctgatgctgagtatgtgtattttaattggaaggacgcctccagttttacgcctgctctggaacaggtaaaacagatctatcttgttgctccggtcggtgtatttgatccggctccctatgtgctcccctttttaaaggaggcaaagcgtctcggtgcaaagcgtgtagtgatgctaagtgcgtctgttgttcctgagaatggccccgtgtttggcgcgattcatcaggcagtgcgcgaatttcccgaatggacggtgctgcggccttcatactttatgcaaaatttcatcaatgtccagcatcgaatgtcgattcaaactgaggggcgcatcatcacggcttcgggtgagggaaagctaggattcattgatgctgatgacattgcagaaacagccgtgcgtgctttgactgatgccgtccctcatcagacacatcatatcctgacaggacctgaggcgctgagctatgccgaagcggcagagattatcggtacagcggcgggacgccgggtggagcatgtcatcatttctcgttccgagctgcagaatcggatggaagcagctggtttgccggctgattatgcgggatttatggcggggcttgatgaggcaatcagccatggtgcggaacatcgggtaacggatacagtgaagcgtgtgacgggaaaagaccctcgttcgctatcagagtttgcggctgctcatgctgtgtattggaaacactgatctcattttggactaagtagtctagaaagaccttcggcgcttccgaaggtcttcttattgaaaaagctaagtcgtgtttcagtcataatcatgcctcctgcctcatacctattaaggtcattgtttttgagaaaggaggagccggaatgaaggatatgcagccgtttacgcctgtcaaatcatatacgccctttcacagccgttttgatccctgtccgcccatagggaagaaatattacagaacgccccctaacctttatatgacctttcagcctgagcatatggagcagttttcgccgatggaggctttgagaaaaggcaccctttggaaggatctctatgatttttatgaaaacccttatcgagggggagacgcacatggcaaaaaaggttgatgccgaatattatcgtcagctagagcaaatacaggctgctgattttgtgcttgttgagctgagtctttatttgaatacacatcctcatgatgaagatgcgctgaagcaattcaatcaatattccggctattcaaggcacttaaaaagacagttcgaatcctcttacggaccgcttctgcagttcggcaacagccccgcgggcaaggattgggattggggaaaagggccatggccgtggcaagtataaggaggaatgcctgaatgtgggtgtatgaaaagaagctgcaataccctgtcaaggtcagtacgtgcaacccgacgctggcgaagtatttgattgagcagtatggcggagcggacggcgagctggccgcagctctccggtatttgaaccagcgttatacgattcctgataaggtcatcggtcttttaacagatatcggcacggaggagtttgcccatttggaaatgattgcgaccatggtctataagttaacgaaagacgccacaccggagcaactgcgtgaagctgggcttggcgatcattacgtcaatcacgacagcgcgcttttttatcataatgcggcgggcgtgccgtttaccgcgagctatatccaagcgaagggcgatccgattgccgatttatacgaagatattgccgcagaagaaaaggcgcgggcgacgtatcaatggctgattgatatttcggatgatcctgatttaaacgattccctgcgttttttgcgtgagcgtgaaatcgtacactctatgcgcttcagagaagcggttgaaattttaaaagaagaacgggataaaaagaagattttctaataggcagattggcctctctttcatacacccttttacatacagagaaaatggtctgtttttgcagtttggtctgcattataatcaaggtgtgtgtgcaagcttactttttgattgggaggcctttatgtcagcttttaagattgagaacgaaacgattgcagatggattttacgcgtgtccggccgtctatgaggatgcagaatcgattaccgggttgctcgtacgaacagctgaatggctccgggatcggggttctaaccaatggagcggacttctgaaagggcaagatatacatgatatcacggggtcaattgaaaagggacatgtgtttgtgtttaaaaaagatgaagagcttgcggctgtcgtgatgctgctgcctgaaccgagcgagtgggaccggacgctttggggagacgatgggcatgaggagtccatttatttgcatcgcctcgcagtaagccgccggtttgcgggacaggggcttggagcccgcgtccttcagtgggcggagacgggcatacactttccggaaaaaacgcggatccggcttgactgtgtcgctgatagtgacgccctgcattccttttatcggcgtatgggatatgaattcatgggtgctgatgcgtccggatatcatttgtttgagaaagagattacggcagaataagcgtcctttgcagggggcttttttgtcttttctaaaagggagggcaggcgatgttgtggccaatattatttgtgacagggatcgtgacggcttgtctgtttgctggcgtatccgttttgatgcggatgagatttcctgacaaaagtcggccggaatggatgtaggccgggctgatcgtccttggtgtgtttctgatctggtagagcctcgtatatgcacgcggctgggaaggggctgcgctcggaatgcttggattcaatgtcattttcggagccattgccggatatttgatcgataaggccatccggcgttactggaaaagataaggctgctgctgtctctcatcatgtcgaaattttcacagaccggcaggaattttctttcgaaaggagaaatacatattactttaaaatgaaagcgttttccaaagcaggaaggtgatgttgatgatacacagtgtgacaaatgggctgaatcgtttttgtacgtgggtgatgagactggcctatttgaatgtgctttggattttgttttctcttgcaggcctggttgtgtttgggctgatgcccgctactgccgcgatgtttacagtggcgagagaatgggcgaaggggaatacagatgccccggtgttttctgtcttttttcggacgtttaaaaaggaatggcgggcatcacagatcctcgggcttatcgttgtgacggctgccctgtttctgtttgcggatatgcggatagcggctcagatggaccagcctgtgctcgtcaatgtattcctgagcattagtttgattttcgcgtttgttgtgctgtatgtgttcccggtattttctcattttgacgtaaaaatcagagaggtgctgagcatcagctttttcattgctttcagccgtccggcggtaacgcttttgatggcggcgggcgctgtcggtgtgctttgtctcgttctgtttcatgtcacgtttctattgtttttcagcgggagtttactcagcctgatcttaacgaagctgtcctttaaagcgtttcggtcaatggatcagcggcaggagaaagaaaaggcggcatgaagaaaagagttgctggctggtacaggcggatgaagattaaggataagctgtttgtgtttctatcgttgattatggccgtatcctttctgtttgtatacagcggggtccagtatgcctttcatgtgtatgatgagcagatttaccgcaagtcctcggaggtgcttcggatgtcttctgaaaggatcgaagacgagctgaagaagatagaggatgtgtcatatgaaatcattacagacgaacagattcagcgcatcatgagtatgcaaaatcgggatgatacgtatgatcaatatcaaatgaagcaggagctgtgggatcagcttgcgggatatgccagcgatgaaaagtacatcgattccattcatgtgattgatgcccgcggctcagagtattcagccggaagcagttcttcagatcttttgcagcaggagcaggaagaggtatttaagcgagcgaaagcgaaaaatggaagaaatctttggatgacgctcggcgggtcagatcctgtcctgatttcagcacggcagatcaggtcctatcaccagctgagtttgaacggcttgggcatggtgctgatccaggtcaatgtaaaacagatgattcgtgatgtgccgaaggattggggcgattcagtcggagacattatgattgctgaccaaggcggtaatttggtgtatacggcacatgcatcagcgcatgttcctgaggcagcaaaagagacgctgaagcaccccggttatgacttgataaaaaagaatggcaaacgttactttatttcttaccttcaatcatcctaccaaaattggagctactataacgttatcccctttgatcagatgttcgcaaaaatttcctttatgaaaacagtgatcggcacatgctttcttctctttttctgtgtggttttgcttttcggaaggaaaatcgccaacagcatcacggagccgattgaacagcttgtgaccgcgatgaaatcggtgcagcacggcggcattgaagcaggtgtgtcgctttctctgccggaacatacacaggatgaggccggcatgctgaaccgccattttactgtcatgatgaaacggattaatgagctgatggaagaaaatgtggaaaaacagctcattattaaagaaaccgaattgaaagcactgcaagcccagatcaatccgcattttttatataacacgctcgagtccatcaattggctggctaaggcgaatcagcaaaagcaaatctcaaaaatggtggaatcgctcggttttcttctgcgaaacagcatacatatgaaaaaggatatcgtgaccattcaggaggaggcggacattgtacgtcactatatgaccattcagcgatttcgatttgaagagcgcctgaatttcacgttggatattgacgatgaggtgaagcattgcctcattccgaaactgacgctccagccgcttgcggaaaatgcgattcaatacgcgcttgaaccctttacaaggccatgcgccatccggattcaggccaaaaaggcgaagggctgtgtctgtattacggtcgaagataacggccctggcatggatggacggattcttgaatcaacgggcggaagaggaatcggactttggaatattcgcgagcgcatcagcctgacattcggagagccatacggattgcggattcatagtgagcatgaaaaggggacgaggattgtgatcacaataccgtgccgaaatgaggtggtgtgatgtataaaatactgctggctgatgatgagaggattatccttgatggaatggcgggaatcattgagtgggagtcgcttggcgcctcattgatcggtaaagcgcagaacggacatgaagcatatgaaaagattgtacataagcagccgcatatcgtcatcacagatgtcaaaatgcccggcatggacgggcttgagctgatcaaaaaggtgtcagccgtcagcccgtcggtgcaatttatcgtcctgtccgggtttggagagtttgagtacgcaaaggaagccatgaaatatggggtgaagcattatttgctgaaaccctgcaatgaacagcagattatcagctcgctggaggaaatcattgctgagctgaagcggcaagatgtgcacaaaaagaaaacagcccatctaaaacacgagctcgaccatatccgttcctttgcagccgatcaatacttggaaggcttgatcgccggtgtggcccagctttctccgccgccttcacttgccggaaaaaagatccgcctcttgatcttaaaaggggaacaatctattgatgccgcagccagagaggcactcgggtcggcactgacagcggtttgcagcagcggagaatggaccgtgctcgccgtagaggagaacgccgctgaaaaggcggaggaggtttttgcggaccgcaagctggtcatcagtcaggcgggagaactccggcacgcggggcagctgtttcgggacacagctgaagcgtctggtgacctgcatgggagcgcagtgatttcgaaaatgatcaggcttattgccgacgagctcggaaatccgaatctgtccttaaaatgggcggcgaaggatatgttgtttatgaatcctgattatctcgggaagttatttaagcaggaaacaggcgagaaattttcccaatatgttacacgagtgcgtcttgaacatgcgatgaaacagatgaaaatgaggcgggatgcgagtgtatcagaaattgctgaagaaatcgggtttggcgataatccgaagtatttcagtcttgtttttaaaaaatataccggtctgacaccgtcagaattcagaagaaaacagggaggcgcttccgcaggatagccatctctgtttttttgactttcgccactgttttttgagtgtttcgccctatccgaacgctttaaaataaaatgtaagcacttacattaaaggggggattggtttgaagaagatttgttacgtgctgttatcccttgtctgcgtcttttttttcagcggatgttcagcgggtgaagaggcctcgggaaaaaaagaagacgttacactcagaatcgcgtggtggggcgggcagccaaggcatgattatacaacaaaggtaattgaactttacgagaaaaagaatccgcacgtccatattgaagcggaatttgcgaactgggatgactactggaaaaagcttgcgcccatgtctgccgccggccagcttcctgatgtcattcaaatggataccgcttacttagcccaatacggaaagaagaaccagctggaagatttaacgccgtatacaaaggatggaacgattaacgtcagttcaatcgacgagaatatgctgtcgggcggaaaaatcgacaataagctatatggatttacgctaggtgtcaacgtgctgtctgtgattgccaatgaagatttgctgaaaaaagccggtgtgtctatcaatcaggaaaactggacgtgggaggattacgagaagctggcgtatgatcttcaggaaaaagccggtgtctacggttccaacggaatgcatccgcctgatattttcttcccttattatttgcgcacaaagggtgagcgcttttataaagaagacggcactggcctcgcgtatcaagatgatcagctgtttgtcgattactttgaacggcagctgaggctggtgaaagcgaaaacgtccccaacacctgatgaaagcgcacagattaaagggatggaagacgattttatcgtcaaaggcaagtcagcgattacatggaactactccaatcaatatttgggctttgcccggctgacagactcgccgctgtctctctatctgccgccggagcaaatgaaggaaaaggcgctgacattgaagccgagtatgctgttttccattccgaaaagctctgagcataaaaaagaggcagcgaaatttattaatttcttcgtgaataatgaggaagcgaaccagctgattaaaggcgagcgaggcgttccagtctccgacaaggtggcggatgcgattaaaccgaagctgaatgaggaagaaaccaacatcgtggagtatgtagaaaccgcgtcaaaaaacatcagcaaagccgatccgccagagcctgtgggaagcgcggaggtcatcaagctgctgaaagatacgtcagatcagattctgtatcagaaggtatcgccggaaaaagccgccaaaacgttccggaaaaaggccaatgagatattagagaggaataattgacgggaaatggggctgacgcaatgaaaaaaagccggagtataagaaaagacaatctggcgggatatgcttttatttctccgtttatcatcgggttcctatgctttacggtgattccgatgggggtgtccctgtttctgtccttcacgagctatgacttgtttacggcgccgaaatggatcgggctcgacaactttaaggaaatgtttacgggtgacgaaaagtattggcagtctctgaaggtgacgtttacgtatgtgcttgccggggttccgctccgcctcggcttcgcgctttttatcgctgtcattttaaacaatgcagcaaaaggaacggccatttacagaacgctcttttatttgccttcgatcatcggcgggagcgtcgccgtggcgattatgtggcgcaatatttttggcaatgacggggtcatcaatgcgctgctgttttttgtcgggattgatcaaaaaattctttggtaccagaatccgacaagtgcgctgtggacattgattctgctgtccgtctggcagttcgggtcgtcaatgctgatttttctggccgggctgaaaaacattccgtcttcgtatttggaagcggcaagtgtggatggggcaaatcgggtgcagcgtttcttcaagatcacgcttccgatccttacaccgattattttctttaacctagtgatgcagacgatttctgcttttatgacatttacacctgcctatatcatttcgaagggcgagggcgggccgcttgacgggacacttctctattcgctctatttgttccagcgtgcgtttaactattttcaaatgggctacgcagcggcgatggcgtgggtcatgcttgtcattgtcgggctgattacgctcatattgtttaaaacatcgtcatattgggttcattacgagtcaaaggaggaatgacggatggagccggtcaacgagcctgtcagaaaagccccggtttttgaaagaaaaaaagccgggcgcgtcagtcccaaacgcatactgttccatgtttttacggcaacgctggcggtgttactgctgtacccggtcatttggctgtttgtcagctcgtttaaagaaagcgccagtatttttacaacctcacattctctcattcccgacccttttattctcagtaactatgctgaagggtggaagggtatcgcgggacagccgtttctgacgtttattaaaaactcggcgatcattgtcggactgtcaacaatcggtgccgtcctgtcatcggctgtcattgcgtacggatttgcgcgtattccgtttaagggaaaaaaattttggtttgcgtgcatgatggggacgttaatgctgcctcatgaagtgttgatgattccgcagtatattatgtttgcgaaattagactggctgaattcctttaaaccaattgtcgttccgcaatttttcgggcatgcgttttttatctttctgatgatccagtttatccggacgattcccgaggagctggatgaagccgcgcgaatcgacggatgcgggcgctttgcctgcttttggcggatcattctcccgctgattgcccccgcgcttgcgacgtctgcgattttctccttctattggaagtgggaggagctgattcagccgcttttgtatttgaataagccggagctttaccctgtttcacttgcgctgaagctttttctcgatacagagtcggcttcgaactggggcgcgatgtttgccatgtcggccgtctcgttattgcctgtgattcttgtattctttttgtttcagaaatatatcgttcagggcatcagtacgaccggattaaaataaaaaggagtgttgcagatggcacagcttatctttgatgaagaaaaggtgacgtcggttattgaccggatcgtgaaacggacatttcagatggattttgcgtgggattggcctggcggcgtcgcgttttacggtgtggcggaggcctatgaagcgacggaaaacgaggaatatatcaatctgttaaaaacgtgggtggatgaacagctggaggatgggctgccgccgctttcgatcaacggagtttccatcgggcatacgcttttgttcctccacaaggtgacaggtgatgacgtgtatttggaaacagcggccgagatggcggaatatgtgctgcataaggcgccgcgctttggcgagggtatccttcagcatacggtgaatgcggcagaatacgtattccctgaacaggcatgggcggatacgctgatgatggctgggctgtttatgctgagaatcgggcgggtcatggagcgtgaggattattttgaagacggcctgcgccagtttcacggacatgaggatgtgcttcaggaccctgtcacgaatttgtactaccacgcctgggacaacaaagcgcaaaatcatctgtcggggatttattggggcagggcgaacggctgggcggcactcacgatggcaaaggcgctcccgcttattgaggtgacacatccttcctttatgatcatcgacggatcgctcagagaccagctgagcgcgcttgtccggcttcaggatgaatcagggctgtggcatacgattttggatgatccggattcttatctggaggtttcggcatcagcgggtattgcttctgctctgatgtcgagcggaaagctgtatacaaaatatgtgcagaaatcgcttgccgccattttggatgcagtggaagaggacggacgggtcagcaaggtatcggccgggacagccgtcatgaaaaatgccgaaggatacaaacaggtgccttacaaacgaatacaaggatgggggcagggacttgcgctgacgtttcttgctgatgttttgaaaacgaaaaaacgcgtgtatcagtaaagatagcggcggggggagagggatgaaaaaacagcctcaacagaaggaacgggtttctcgctggaagggaacgtatttcaaaagaaactttgtcttcattttgctgattgcctgtattcccggattgctgactggcggcgcaatctactttctttcgatcgacaaggtggagaaagagctgcaaaggtcgcatgaaacacaggtggcgcgtgaggtcagccgaatggatgagaagctgggagtgcttgaactggcactcacccagatggcctacgattcttcactgatgaatggattggccgagagggatttggagaaagactttacgttctcctatcaattaacgaaaaagctgtttcttttgcgggaccagcagccgctgatcgagcaggcttccatctttctgaacagcccccggcctcttgtgctgagccctgaatacagcgctttgacagaacaagagggccttcgcaagtatcgctcgctgcttgcctcagaccacagcatttattggaaacggtcgggaaatcaagcgatgctgatccagctcattccgggcgcggcggagaaaccgttcggcgcgatcatgctggcggttgatccgaaagaaatggaatcaatcctgcaaagcttgtccccctatcctgatggcagtgcgctgcttttagatcaaaatcaagaggtgctgtttcatgaaggggaaaaagattttgaaaagactttacttcaagagataaaaaaacagcctgctgagaaaggtcattttcagatggaatgggaaggcaaggtgtattctgtctcctttggagaaatgaaccggatgcatcagcaatggacctttgtgtcagcggcgcctctttcagctattacagcgccgatggtgtttttatcaaaagtgatcatcgtgatgctggtcatttgcatcggtttggcggtgtgcatgacatggtatgcatcaaaaaaaatctatcgtcccattcagcatttgcttggcttgtttaccggtggagagaagaaagtatggcaggcgtccgggcaggatgaattcaagtggattgaaaagagatggcaggatctatcccttgaaagccggaagctccaagagcagctcctgcggcagacgccccatatgaaaaaaagttttttgcagcatctcttgcagggcgatttttactatgacaacgaggaaagcctcagattgcggatggaggaggctggctggaacatcggcggaaacgtgtttcatgtgcttgatctacaggtgacagggctccgttgtgaaaaaagcatcttccgtgaaggtgatgaacagcttgccgtgtttaccctgaccaatctggctgaggaattggcggataaacacgtttttcagctctccatacttgatatcggccggctttctgtcaccgttcttgtgatgaaaacaaacagctctgatctgaaggcgtatataacggagctggcacgccaatttggggatgtaaccggactatgcctgacctcgacatggagcagcaaaacggagcgtgtcacggaaatcccttctttatttcagaatgtgaaatgcggcaaatcccgcaggaaatttgctaaccgggatcaggtcattgatttgcaggccgacttccctcaggatgagcagttcgctccttattacccttttgagctggaaaaacaaattgttcaggccatccggctggaaagaaaacaggaagccaaggaactgatagatggatgtatgagggaactggcggaaaaggcggccatagacaggcatgtgcattccgccctgattcagctgttttcccgcattcaggaggatattttgcattccgggctcaatcccagcgaactgtttcagcaccggaatccgtttcttgatatttcagaattgcgcgaacctaacgaagcggcggcctggctgatggatgtagtggtgacgccttacctttccaagcttgagggcagaaaaaacagacagcaaaagcagctggcagaacgtgtgattgcgatgattcacgaacagtatatggcggacatttcattggaaagctgtgccgatgcgcttggcatgaattcatatacgttaagcaaggcatttaagcaagtgaccggcattaattttatcgattatgtgacccagatcagaatcgaaaaggcgaaagaactgctggtcaatacgaataaaaaaattcatgacgtgtcagaagaagtcggctaccgccacaattatttcaatcggatttttaaaaaacaggtcggcatgccgccgggtgtcttcaggcaaatgtatcaggaaacgccgtgaaaggagagaacatgtgatgaagaaaccgattcaagtatttttagcgggagattccactgtgagtgactgcccgcctcatgaagcgccgatggcggggtgggggcaggtattcgggcaattgttttctgaagatgtgctggtccgcaatcatgccaaaggaggagcgagcaccaattcttttgtggaggaaggaaggcttcaagcaattgccgagcacatcacacaaggcgattatttgttgattcaattcggccacaatgaccaaaaaccgcgggggacgaagccgtactccacatttcagcagtttcttaccttgtttgcagatacggcacgcgaaaagggcgcgcatcctgtgttcgtcacatcggtgcagcgccgccgctttgatgaaaacggacggatcgagcatacgctcggtgagtatccagatgcgatgaaagcactggcgaaggagctcgatgtacctgtgattgatctgcttgcgaaaacaaaggtgctgtatgaagcatacgggccggaggagtcgaagcgattgttcgtttggtttcagccgaatgaacatccgaattacccggacggcattgaggacaatacgcatttttcggaaaaaggtgcaatggaggttgcgaagcttgtggcagaaggcattgaagagatcggacttccgcttaaggaccgccttgtgagccgggaggggaaagaacatgtataaggaaggcgcgtgcctgtaccgtaatccgctccggtctaaaagcgatgtgaaggactggcggatggagggaggcggacagatctcatttgacgatcacagcttgcacctgtcacatgtccaggacgaagcgaactttgtcttttggtgtccggaaacctttccagacggcatcattgtgacatgggacttctctccgatcgagcagcctggactgtgtatgctgttttttgccgctgcgggtattcgcggcgaggatttgtttgacacaagtctcaggaaaagaacaggaacataccctgagtatcattcaggagatatcaatgccctccacctgtcgtatttccgcagaaaatacccggaggaaagagcattccgcacctgcaatttaagaaaaagccgcggtttccacctcgccgcaatgggggccgatccgctgccttctccagacgacgctgattctccgtatcgtatgaagctgatcaaagacaaaggctatgtgcacttttcaatcaatggtctgcccattcttgagtggatggacgacggcagcacttatgggcctttgttaacaaaaggaaaaatcgggttccggcagatggcccccatgaaagccgtttacagggattttgccgtgcatcaagcggtgagaagatgaagacgactgtaacggatgcgctttatgcaggctgcgaagcggtggtgaaaatagcatggctcaacgggctgtggctgttgtttacacttttgggcggcgttcttttcggatgggcgccgagcacagctgcgatgtgtgccgttataaggaaatggctgatggggcaaaaggatgtcccgatattttcgttatttctcgatacctataaaaaagagtttctcaaggttaatgcgatcggattggcgttttcggctcttttgctcatattgtctgccaactatcattatttttctgccagtacgaattggctgtcctttgccgtaacaagctgcacgctgcttgcagggcttttgtatatcatcgcgctgatgtatgtgtttcccctttatgtgcattaccagctcccgcttcgcaaatatattccgcaggcactgctgtttggcgccatgaggccgctgacgaccggctgtatgctgatcgggtgcggatttgtcctttatttgctgtatacgcttcctggcctgattccgttttacggcccatgtttatttgggcttgtgttgatgttttttgctcttaggggatttcaaaagacggaggcccagcaccatcaagccgggtaacaaaaaaatgacaaatacgcaaaaaagtgcagtgtccgaaataggcagatgcaaaaaagtgaaattgaagacagctcacatagcgcataaaatccaatttaagtaagcgcttacagataaatgagaaggagctgtctgatgattagacgaaggaaacgcatgtttaccgctattacgttgctggtcttgttggtgatgggaacctctgtatgtcctgtgaaagctgaaggggcagcgcggcagatggaagcgctgaaccgggggcttgtagcggtcaagacggacgggggcatttttgtcagctggcggtttcttggaaccgaaaacgcatctgttttgttcaatgtgtacagagacgggcaaaaactgaatgctgcgcctgtcaaaacaacgaactatgtggataaaaacggatcggcgggctcaacgtatacggttcgggctgttgtaaacggtaccgaacagccggcttctgaaaaagcctccgtatgggcgcagccgtatcattccgtcccgctggataaaccggctggcggcacgacaccaaagggtgaagcttacacgtacagcgctaatgacgcaagtgttggcgatgtggatggtgacgggcaatacgagctgatcctgaaatgggacccgtctaactcaaaagacaattcacaggatggctatacgggtgacgtgctgattgacgcgtataaactggatggcacaaagttatggcggatcaatctcggcaaaaacatcagagcgggcgcgcactacacccagtttatggtgtatgaccttgatggtgacggaaaagcggaagtggcaatgaaaacggcagacgggacaaaagacggcacgggaaaagtaattggaaatgccaatgctgattacagaaatgaacaggggcgtgtgctttcaggccctgaatatctcactgtgtttcaaggttcaaccgggaaagagcttgtcaccgcaaattttgaaccggcgcgcggcaatgtgtcggattggggagacagctacggcaaccgtgttgaccgttttctcgccggcattgcctaccttgatggacagcggccgagcctgatcatgaccagagggtattacgctaaaaccatgctagttgcctataacttcagggatggaaagctgtcaaagctttggacgctggactcctcaaagtcaggaaatgaagcgtttgccggacaggggaatcacaacctgagcatcgcggacgttgacggggatggaaaagatgagattattttcggctcaatggctgttgatcatgacgggaaaggcatgtactcgaccggcttaggccatggggatgccctccatacaggagatcttgatccgggccggccggggcttgaggtgtttcaagttcatgaggacaaaaatgcaaaatacggcttatctttccgggatgctgcaaccggaaaaatcctttggggcgtttatgccggcaaggatgtaggccggggaatggctgctgatattgacccgcgttatccgggacaggaagtgtgggcaaacggttctctctactcagcgaaaggggtcaaaatcggaagcggggttccgtcctctaccaacttcggcatctggtgggacggcgatctgctccgggaacagctggacagcaaccgaattgataagtgggattatcaaaacggcgtatcgaaaaatgtgctgactgcatcaggcgcagcggctaacaacggcacaaaagcaacaccaacgcttcaggctgatctgctcggtgactggcgcgaggaagtcgtgtggagaacggaggacagcagtgcactgcgcatttacacgacgaccattccgactgagcacaggctgtatacgctgatgcacgatccggtgtaccggcttggcatcgcctggcaaaatatcgcctataaccagccgccgcacacaagcttctttttaggagacggcatggcggaacagccaaaaccaaatatgtatacgccttaactgaaagggggaaggaacgggctgcgtgcagcccgttcccatcaaatgaaaccaaaaaagaggcaaatggaatacctgaccagaggtttgattgcggtaaagacagaacagggcgtgtttgtcagctggcgtgtttgtcagctggcgttttctcggcacggatcatgagacgacggcttttcacctttatcgggatggaaagcggatcacccgcgatccaatcgctgaaagcactaattttctcgatcaaaatggaacggctgactctgtttatcaagtggcggctgtcaataaaggacgggaagaaaagctttccaaggaagctcgtgtttggcaggaaaatgtcctggaggttccgcttgccaaaccggaaggcggtgtgacgccggacggaaagccgtacacttacagcgccaatgatgctagtgtcggggatatagacggggatggagaatatgaaatgatcctgaagtgggacccgtccaattcaaaagacaacgctcatgacggttataccggggaggtgctcatagatgcctataaactggacggcacctttttgtggcgcatcaacctcggcagaaacatcagggcgggcgctcattacacgcaatttatggtgtatgaccttgacggtgacggaaaagcagaaatcgccatgaaaacagctgacggcacaacagacgggaaaggacatatcatcggtgatgagcaggccgattttagaaacgaacagggcagaattttgtccggcccggaatatttgactgtgtttaaaggagaaaccggtgaggcactcacgaccgtggaatatgaaccgccccgcggcaagctggaggattggggagacggatatggaaaccggatggaccgttttctcgctggaatcgcttatttggatggggagcggccgagccttgtaatggcacgcggctactatacgagagccgtgctcgtggcatacgatttcagaaacggaaggctcaaaaaacgctgggtatttgactccaaccatccgggacatgaagcgtacgcaggacaggggaaccacagtttaagcgtggcggatgtcgacggagacggaaaagatgaaatcatatacggcgcaatggctgtcgatcatgacggaaccggcctgtactcaacggggctcgggcacggagacgcgatgcatgtaggggatctggacccgtcacgaaaagggcttgaagtgttccaggtgcatgaggacgccacgaagccgtacggactgtcgctgcgagatgccggaaccggtgagatattatggggcgtccatgctggaactgacgttggccggggcatggcggctcatattgatccaagctacaaaggatcgctcgtctggggaattgatccgccgggcaatgatggcatgtcgtatgggcttttcacgagcaaaggcgaaaaaatcagcgacaaagcgcccgcttcagccaatttcgccatctggtgggacggtgatttggtcagagaactgcttgatcatgactgggacggaacgatcggcaggccaaagattgaaaaatgggatgctgaaaacggctgtctgaagacgatatttcagccggccggcgtgctgtccaacaacggcacgaaaggaaacccggttcttcaggccaacctgttcggagactggcgggaagaagtgatatggagaacggaagacagcagcgcgctccgtatctatacaacgacacatctcacccgccaccgcttttacacgctgatgcatgatccggtttacaggctcggcatcgcctggcagaataccgcctacaaccagccgccgcacacgagcttttacctcggaacgggaatgaaaaaaccgccgaagcccgccctgtacatagcgggaagtaaagcggaggcaccgctgtaggaggactaagggataagacgcaaaggctgaactctacgacaagatgattaacgaacgggcaggacgaaccaatgctcaagcgctgtacgcaccggtctttttcaagggaagagctatccgtgatggaagctgtataaaaaacgagggggaatgaaaaatggcaaatcatatttatcttgccggcgattcgactgttcaaacgtatggagacagcacaaatcaagggggctgggggcagtttctcggctcgcatctgccggagcatattcaggtgatcaacagagcgatcgggggaagaagctcgaagacatttgtcgaagagggcaggcttcaggcgatcctcgatgtgatcgagccggatgattggctgttcgtgcagatgggccataatgacgcgtcgaaaaataagccggagcgctacaccgagccctatactacttataaacaatatttaaagcagtatatcgcaggcgcgcgggaaaaaggcgcccatccgcttctcattacccccgtagcccgctttcattacgaaaatggcgtgtttttgaacgattttccagattactgcattgccatgaagcagacggctgaagaggagaatgtccagctcattgatctgatggagaaaagtctcgctttctttactgagaagggcgaggaaaaagtgtacacctattttatgatttcagaagggattaatgattacacgcattttacaaaaaaaggcgcaaatgaaatggcgaaacttgtagcaaaaggcataaaggagctcggcctgccattgacagaatcgatcatcaaagaaaggtgaaaatgggatgagaaaactgtatcatggtgcttgctattatccggaattatgggatgaagagacgattcagcaggacattgacatcatgcgtgaagttggcgtaaatgttgtgcggatcggcgaatttgcctggtctgtcatggaacctgaagaaggaaaaattgacgtcggttttttcaaagaaatcatcgcccggctgtatgaaagcgggatcgaaacgattatgtgcacgccgacgcctaccccgccaatttggttctcacacggccggcccgaacgcatgcatgtcaatgaaaaaagagagatcatggggcatggctcccgtcagcatgcctgtacgaacaacccgtattttcgaaaaaaagccgctatcatcaccacagccatcgccaaggagcttggccggctcccggggctgatcggctggcagctagacaatgagtttaaatgccatgttgcagaatgcatgtgtgagacgtgcttgcgcttatggcatgactggctcaaaaatcgctatggggtgattgagcggttgaatgaagcttggggaaccgatgtgtggagcgaaacctatcaggcgtttgagcaagtcccgcagccgggaccggccccatttctgcatcacgcctctttaagcactatgtatcagttgttttcgatggagatgatcgcttcgtttgcggatgaacaggccaaaatcatccgctgctattcagatgcgccgatcacgcataacggatcagtcatgttcagcgtggacaatgagagaatgtttcagaatctcgattttgcctcctatgacacatacgcttcgcaggaaaacgcctctgcctttttattgaactgtaatttgtggagaaatttgaaacagggacgcccgttttggattttggaaacgagtccgtcgtatgccgcctcgcttgaaagctccgcttacccgcacgcagacgggtatttgcaggctgaagccgtatcgtcctacgccttaggaagccaggggttttgctactggctatggcgacagcagcgttcaggcagcgagatttcccacggttcggttctcagtgcctggggcgaacccaccatcggctaccaaaatgtgctggcggttgagcgggcaagaaaggaaatcgagcctgttattctatcgactgaacccgttcaagccgaggcggcgatgacttactctgacagagcaaaagcatttattaaaactgagcctcaccggggactccggcatcgttcgcttgtgacgcatttttatgaacgtattctcaacacggggattcaccgtgaccttattccggaaggcgctccactggacggatatcgcttgctgtttacgccatttgtgccgtatttgtcttctgaatttatcaaaaaagcttcggcattcgctgaagcgggcggcatctggattgccgggccgttgacaggagggcgcacatgcgagcataccattcataccgattgcggacttggcgaacttgagaaaacgtcagggatcaaaacactgtttacctttccgatgaatgagaacgtgaatacaggaaaagcgtttggcatcacggcgccgcttgggctgtggagcgcggtgtttgacacagagagcggaaacacccttggcacggttgaagcaggaccgggggcgggccatgcttttctgacggaacggaattacggcgaggggaaaattgtcatgctgggctcgcttccatccgggaaagaaggggatgcgatgctggaagcgctcgtcaggcattatgcggaggaagctgttatttccagccggtcggatgttacgcccggcacgatcgttgccccgcgcaaaggcgataacggccttgtgtggatcatcgtgaatatggatggaaaaggaggaagtgtgacactgccggaagcgggaacagatctgttgacgcaccgcttggaaaaggcggggaggctggcggtcggaccgcatgaataccgtgtgattcaatttgacaatcccagctgattctttgcatcgaatcagcttttttctatggagggagagaccgatgaaaaagatcaaatggttatcaggacagccaaaggtgataagcggtgtgacgtggggcgtgccatggaaaaaaggagaattaaaaaagggtgaccgtctggcgcttatgaataaaaacgcggaaacgcgatatgtgcaaagcgaaccgtcggcctattggccggacgggagcatcaagtggacaaagcacgcggcggtgtttggcggtaaggaaaaccaaaactttatcgtgcaaaaaagagaagtcccgcagccaactgaatcgctcagtattcatgagacagagcacgatatccaagtggatacaggagcactcgtttgtaccattcataaaacaggatctgatttcattcaatcattgcagatcaacggaaagccgatcgccgcaggcgggaggctcgttgcgataagagaaacgagaaaggagtcagcggcggaaacggttctttttcaagaaacgtctgtcagctttatcaaacgggcgacgattgagcagagtggtcctgtcaaagcagtagtcaaaatcgagggagtgcatgtgctccataaaacgaatgaagaatggctgccgtttgtcatccgattgacgttttatgccgggctgtctgagatcggccttgtgcacacgcagctgattgacaggagcggtaaactagaattcgttaaggggctcggcatcgaattcgacctttttttggagggagagccgtacaaccgccattttcgctttgcgggagagaaagggatgtacaaagaacccgcccagctgtttggtacacgtaaattcaatgaacgatatccgctttatgaaaaacaaatcaatggcgaaatgctgtctccagatgaagagcataaggaatggtttgcgcacggaacacagaatgcggtttgggacgatgtgaagcttgttcaggattcaagcgatcattacagcctgtcaaaacggaccggaaaagattatgcgtggatcggcatgctgcatggcagccgggcgaaggggctttgctatgcgggcggaaaaaatggcggtgtggctctcggcctgcggtatttctttgagaaatatccgtcagcactggaaatcacaggtcttgccggcagccgccccaaaatgactatctggctttggcctccggacggcgaagcgatggatttgcggcattatacaggaaacacccacgtggccagcgcgtatgaaggctttgatgaaatgcgctctgatccgacaggcattgcgaacacaaatgaaatcagcttggcgtgcttttcgcacatgccgtctgacgaagtcctcaatgcgctcgctgacaaatggcaggcgccgccgctcattgtatgcgagccggacatctattacgaatcaaaagcactcggggtttggagcatcattgacacatcccatccgctcaaaaaagagctggaagaacatctcgatgcggcctttctgttttataaaaaggaagtagagcaacgcagatggtacggtttttggcattatggcgatgtcatgcatacgtatgacccgatccggcatatgtggcggtacgatctcggcggatacgcatggcaaaacaatgagctcgttccgaccttatggctgtggcaggcgtttttccgctcaggcagagaggatatctttcgcatggcagaagccatgacccgccatacgagcgaaacggacagctttcacctcggtgaatacgcaggacttggttcacggcataacgttgtgcactggggatgcggctgcaaggaagcgagaatcagcatggccgggctttataaattctattattatctgacgggtgatgagcggacgggagatcttttgacagaagtgaaggatgccgattatgccctcgtcaaaaccgatccgatgcgcgctttttacgagaaaggcaagcacccgactcacgccagaacgggaccggactgggcggcgttttgctcgaactggctggcggaatgggagcggaccgaaaatccggaatatctcaaaaaaatcgaaacgggaatcaactgtctgaagctgctgccgctccgcttattatccggcccgacatttgaatatgacccggcgacctcgatgcttcatcatttgggagacggcattgcgggcggatatcatatgatcattgccttcggcgcgccgcaagtgtggatggagctggctgagctgcttgatgaccgggaatgggaagatatgctgagtgaattcggcgaattttacacactaagtgatgaggaaaaacggaaaaaaagcggaggcgctcttcatgacgagcattttcactggccgatgttcgccgccggtatgacagcctacgccgcgagaaaaaaacaagatcctcatctcgccgccaaagcgtggaatcttttgctagaagataagctcagccatatgccgcttccgatcaaaccggagcgcatcgagacatggacgcagctagaggagcttccatgggtgacaacgaacactgtctctcaatggtgtttaaatgtcatagcggcactggaactgatcggagattcccttccggcaaaaaaagaaacatcgggcaaaaaaggataacagccggaatttcataggagaaatggtgcaaaaaatgaagattgcaagaatttatgtaagcgctttatattgagaggggcaaaggggaaatgcaaattgaaaaaagggggacttacgcatcatgaaaataagaatgcgaaaaaaatggatggccttgccgcttgctgccatgatgatcgccggatgcagccattcggaaacatccaattcagcaagcgattcgaaagatacgatcaaaattatggcgccgctcttatcgccggaaagcccgagtgataagagtccttcattaaaagcgctcgaaaaatacacaggcaaagagattaaggtcacatgggtgcctgattcatcctacaacgacaaattcaacatcgtcatggcttcaggagagatgcctcacgcgattgtcattaaagataagtcagccggctttatcaaatctgtcaaagcaggggcgttttgggagctgtctccttatttaaaagactacaagaatttaagccaggcagatgaaaagattttgaagaacagctcggtgaacggcgaggtgtacggaatctacagaacgagggatctgattagggcgtgtatgatcatcagaaccgactggctgaaaaatgtcggtctggatatgccggaaacgcttgatgatttctatgaagtgctgaaagcctttaaggaaaaagatcctgacggaaacggcaaggatgatacgtacggcatggtcgtgccgaaatggatgggactcggcaacggaagcccatgggatgttctgcaaatctggttcggcgctccgaaccgctacggtgttgaaaacggaaagctgattccggattttacaacgaaggaatacatggatgcgctcacgttttttaaaaagctctatgatgagggattgatcaataaggactttgctgtcatggattctgcgaagtggaatgatccggttgtaaaaggaaaagcgggtgtcatcgttgatacaggctcaagagcgtctcaaatccaaagcgcgatggaggaggcggatgagtcgaacaaggatatcattgatatcgtcggctcgcttgagggaccgaatggcaagcgcaccttcccgacatctggttattcaggcatgatcacgataccaaaatcaagcgtcaaaaccgaaaaagagctgaaagaggtgctgtccttccttgataagatgaatgataaggaagcgcagattctcacgaacaacggagtgaagggccgcaattacgagctcaaggacggcgtattcacctcacttgaaaaaaacaataaatctctcctgtatgagcatgaaggcttggcacagttcagcatgtcgattccgaaaagcgagtattacatcgaagaccagaaaaccaagctcttccagcatcgcaaggacatcataaccgaaggagaaaaaatagccgtctttaacccggctgagtcgcttgtatctgatgtctatacccaaaaaggagcccagcttgacaacatcattctcgacgcgagaacacaatttatcattggagaaattgatgaaaaagggttcgatgatgcggtggagctttggaaaaaaagcggcggcaatgaactgatgaaggacttgaacaaattgtaccaatcgtcaaaataaaccgatgcgcctgcctttcggcgggcgccccggtatcacgaaaggagaacagatatggaaacagtgccgaagaagggagatgcacctgttctcaccgctggaaaaggcatcagctggatggctgcgctcaaacgggacaaatggctttatcttcttcttattcccggtctgctttatttcttgattttcaaatacttgccgatgtggggcgtgctgatcgcttttaaagactattcgccatatctcggcttctggaaaagcgaatgggtcggctttgattatttcaaagacttttttatgaatccggattttttccggctgctgcgcaacaccctcatgctggcgagcctggatcttttgtttgcctttcccgcgcctctcattttggccctgcttttgaatgaggtaagaaaggccgtgtataaaagatgtatccaaacctttatttacgtaccccattttgtatcatggacaattgtggtcagcatcaccttcgttttctttactgtcgatacaggtgtgatcaacaaattgattatgagcctgacaggtgagcagatttctttcttgtcggatgcagactggttccggccaatgattgtgatgcaaagcatttggaaggagacaggctggggaacgattctatttttggcagcgcttgctacggttgatcaagagcagtatgaagcggccatcatggacggagcggggcggttcaggagaatgtggcatattactctgccggcgattagaagcaccattatcgttttgttgattttaagaatcggcagctttttgaatctaggctttgaacaggtgtatttgatgacgaactcgctcaaccgcagtgtggctgacatcttcgacacgtatgtgtacatgatggggattacccaaggggcgtatagctacagcacggcggtcggtttgtttaagtcagttgtcgggattatcttgatttttggcgccaattacattgcgaaaaagtttgatcaggaaggattgttttagaggagggagaggtatggctgaaattcacacgatgcacaacaccaaagccggacgggtgtttgacgtctgcaacattctgtttctcggcggtgtcggcgcgattaccattttgccgtttttgtatattatcgccggttcctttgcgacagaagcggaactcgcccagcggagcttctttattttcccgaaaacctttacacttgatgcttacaagtatgtgttttcgacaccgacgttccttcgaagcatgggtgtgtccatcttcatcaccgtggtcgggacggctgtacagctgtttttcaccttcacaatggcgtatccgctggcgaagcggcatgtgaagggacggaatctgctgttgaatctggtgattttctccatgctgttttcaggcggcatgattccgacgtaccttgtcgtaaaatcacttggccttttggatacgtattgggcattgattctgccgatggcgattaatccgttcaaccttattattatcaaaaacttctttcagcagctgccgcgcgagctggaggaatcagcaaaaattgacggctgttccgaaatcggcgtcttctggcggatcgccctgccactgtcaaagccagtcatagcgacctttgcgctgttttatgcggtcgggatttggaatgatttcttccacgctctcttatatatcaatgacagtgcaaaatggccgctgcaaatggtgcttcgccaagtcacgattttatcggatttaacggcgaccaatggcgatacgatgcaaaatgccgttccgccggagcagggaattaaactcgctgtcattgtcatagcgacgctgccgattttggcggtctatccatttttacaaaaacactttgcaaagggaatgctgatcggttcggtgaaaggctgagaaagggagtgtttcatatcagtacattagatcagattaagattgcctatatcggcgggggtcccaaggctgggccagaagcctgatgagtgatttgtcgattgatgaacggatgtcaggcacggtggcgctctatgatcttgattttgaagccgctcagaaaaatgaagtgatcggcaatcacagcgggaacggcagatggagatatgaggctgtttctactttgaaaaaggcgttatcagccgcggatatcgtcattatttccattttgccgggatcactggatgatatggaagtcgatgtccacttgcctgagcgctgcggtatttatcagtctgtaggtgatactgtcgggcctggagggatcatcaggggcttgcgtgctgtcccgatatttgcggaaattgcccgggcaataagagactacgcacctgaatcatgggtcattaattatacaaacccgatgtctgtctgtacaagagtgctgtataaagtgtttcccggcatcaaagcgattggctgctgccacgaggtattcgggacgcaaaagttattggcggaaatggtcacggaaaggctggggattgaggtgccgcggcgtgaggatatccgcgttaatgtgctcggcattaaccattttacatggatcacaaaagcctcttaccgccatattgacctgctgcctatattccgtgaattcagcgcgcactatggggaatcaggatatgagctggagggggaaagctggagggacagcgtcttttgttcggcacaccgtgttgcgtttgatttatttgaaacgtatggcgccatccctgctgcgggagacaggcatctggcagagtttcttcccggcccatacctcaaacagcctgaagtatggaaatttcatctcacacctatatcattcagaaaacaagatagagctgagaaacgacaagaaacagaacggttgatcgtgcaacaacggggcgttgctgagaaagcttcgggagaagaaggcgtgaacatcatagcggctcttctcggattgagtgaactcgtcacaaatgtaaatatgccgaatcaaggccaggtctcaaaccttcctatacaagccattgtcgaaacaaacgcattcatcacaaggaaccgtgtccagccgattttgtccggagcgcttccgaaaggtgtggaaatgctggcggctaggcatatatccaatcaggaggcagtggcggacgcaggtttaacaaaggatgctggcctcgcgtttcaagccttcctcaatgacccgcttgtccagattgaccgcagtgatgcagagcagcttttcaatgacatgctccaattcaccatgcaacgttgagcggagcttttccggtttagaaaggaaagcattgaccatactgatagtataatcaagaagtaggtgctatcaatatgggaaattatttaagcgttgcggtagaactggtctgcggtctaggcattttatttatcatcttaaagcttctcgggaaaacccaattttctcaaattacgccgtttgactttatttctgctttaattttaggtgaattagtcggaaatgccgtctacgatcatgaaatcaaaatcaaagaaattatttttgcttcgctgctgtggggcgtgctgatttatattattgaatttatcacgcaaaaaatgaaatcatcgcgaaagttcttggagggtgagccgaatatcgtcatccgcaaaggagagcttcaatataaagtaatgaagaaaaataagatagacattaaccagctgcaaagccttttgaggcaagccgggagcttttcgatccaagaagtagaatatgcgattttggaaacaaacgggatggtcagcgtgcttccaaaatccgactttgacaaaccgaccaataaggatttgcagattccttcgaagtctgtttccctgccgatcactttaatcatagatggagagattgtccgggataatctgaaggaagcaggtgtggatgaacagtggctgaagcaagaattgaaaaagaagaacattgataagacggaggacgtgttatttgcagaatggcataaaaataagccgctgtataccgtaacatacgaacaaagcagatcaacatgactcttagaaaaaagcttgcagcaaggcgcaagctttttattgattgtatgtcccttgtttgacagcacgtacatggtacatgctcacttcagtgctgatcagatagtcaggctttggtttgcctttgtttgctttgtggccggcgatatgcgcatcgcttttttcccattgcttccagcgatcctctgattcccagcgaatcatgacaacaacttcctcatcaccgcggcgtacgtttttctcaagcactgtcacatcaattaaaccttcttgtttttcaatgattccttcagcgctgaaacgttctatgactttatctgcaaagccttctttaaccgtcatttttcttaactgtacaaacatttgtctcactccaatcattctcacatatgaataattgtaaatgaaattcattctcaatgtcaaagaaagcgcagggcggaatcgaaccgccgtgcgcaacagtttattcttttaataaaaacacatttccgtcttcgtccttaaattgaacgaaggtgccccactccatttgattgggctcaccgagaaattctacaccgtttgtcttcattttctcgtatgtaccaaagatgtcttcgcattcaaacacaatagaagccttcatttgctctgagcctttcatcatggctttcgggtaaatgactaaacgagtctcggctccttttggcgcaacctccagccagcttgcttcaggtcccatcgggtggtccgctgcaatatcaaagcctaccttctctgtccaaaattgcttcgctttctgctggtcctcgacatatacagcaacagtgccaatttgtttgatcatagggaaacctccaagttgaaaagataataatactataacctgtttacggccgaagtaacataaaaaaatcagccgggaaaccggctgattattaaaatgagcagcttacaacatcgatgtgatttgtgtctaaggcgaaataaacccagcggcgccgtgaggaatcccaataaaagccgccgacggatcttctgccaaggatgatcgggtaaaaccaaaatgagcggccattggttaaccaaacataggtaaatcggaaaaggcaaggacgaatggtgattggttcaactaacaaaacggctccttgagaaccctgcggttttgggggtttcgctggtatttgggaaggaggaggtccctgcggcgcaccgccgaagcctgggctggcaccgctgccaataccagggccggagccgccgccaaagcctggaacagcgccaccgccaataccagggccggagccgccgccaaagcctggaacagcaccgccgccaatgccagggccggagccgccgccagagcccggaacagcaccgctgccaatgccaggccatggatatcggtattcatattcaaaagcaggccaaggctcataaaaatgccccgcaaacatataaggatcaacataatacatgtgataacgtcctttctcattgtaaactgtacactgcagtttatgcgggcggactcttattggtgcattcgcctaaggatatgaagctgaaatgctctcagagagcagaatcatttgatttttctctagtcttattcacaattccgatttatcattttataatgaaagtgcttctattacgaaaaaggagacagaccgtgaatatcgatcaattattatatcaatatatcatagacaacactgcggatattactgagaaatggttcagtttgcgttgccagctaaaaggcgagctatattccgccagccatttaagtgaagaaacgaaaacacttttaaccgagcagcatacatttaccaatataacaatcgcaagcgcatttctggaggatcaaaccgattttcaagacaacatgacaaaatgggcggaaaacgttgcgaaaaacagggtagagcaggatgttcaagttcatgaggtcgtagaagccatatccaactctagaatctcattctgggacgcagtcgtcacatttataaaagagaatcaggagatcgtgacaaatgaggatgcagaccgatggaaccgcattgtgaatcagtcgttcgataagctgattattgaattctctgagcagtaccaaaaattcatgctgatgaggctcacatctcagcaggaactgatctcagagcttggctgcccggtcatttccattgccgatggaatcgggatattgccgcttatcggctccattgatacaaaacgggcacaggtcattttagaaacagtgccggtccgctgtgtcgagagaaaaatcacaagcctcgtcgttgatctttcgggtgttccgattgtggataccatggtggctcagcaattgtacaacctgtctaaaacgcttttcttattaggcgtcaaagccgtattttcagggattcgcccggatgtggcccaaacatcgattcaattggggcttgattttagtgaatatgaaacgtacggcacgctgaagcaggcattagaaaatatgggtgtccgctgtattgttgaggaattggaagaaaacaaataggaagtttccaggcatatgattgtccgtcaccgggtgatcatatgcctttttgatttgaacagaaatcaccattgatttatcaaaaaaaacataatattataattcttataagaatactgtgaattaaaacctattcaacaggggggaaggtcttttggtttcaaaatcaacgattgatccggaagtgattgaaaaaatcatcagctcgctggaaacactcgatttcggcaccgttcaaattacggttcatgattctcagattacccaaattgagaaaatagaaaagcaccgtttttcgctgaaaaggaaagaatcaaaatgataatgtaaagggcgtttgttttcattaaattctccttaaaacatatacatatttcatccaatttttatataatagacctttaagatcattttttaggaggatttttgacatgcaagctacggttcacgagagtaagcaatcgatcatgcaacgcattttgacagtctttgtctttactttgctgatcgcgactgtcggcctttttatcggccaatttgttcctgtcgctttgatgctgccgctttctattcttgaagtggtgatgattattctggccttctggatgcgcagaagaaaagcggtcgggtatgcgtttgtatatacattcgcgttcgtttccggcattaccttatttccgatcgtcagccattacgcttccatcgccggcgcctatgtcgtgcttgaagcctttggttctacatttgtcatttttgccgtcttaggcacaatcggcgcaaaaatgaagaaggatttatccttcctgtggtcatttctgctggttgcggtgctcgccctcgcagtggtagggattttcaacattttcagcccgttaaactcagcggcgatgatggcgtattccgtgatcggaaccatcgtcttttccctttacattttgtatgatttgaatcaaatcaaacaccgccacattacggaagacttgattccggttatggcgttatcgctgtacctagactttatcaacttgttcatcaacctgctccgcttcttcggcattttgagcagtgatgattaatgaaaaagcgcctgtctttggataggcgctttttttccatacataaaaagggcagatggagtgtttatgagtatcctatcattttaaatacgctggagcaggtcacagtgctggagccatggtacgaagacccgtcatcatcggaggagacgccgcccacgccggtgcgccaaccctggcacaaggagcggcaatggcgatcgaggatgccatcgtcctcgccgaagaactccaaaaccacgccgaccacgaaacagcattacaggcgtactacaaaagaagagccccacgagcgctcaaagtccagaatctatcttcagaaatcgtccgccgcgggctgaaaggagagccgggagcggaagaactgattggggagtgctatgcggtgttgagggaagggtattaaataggaaaagtccagaaagtgatttctggactttttagtcttgctctgttttattccttatccgctcaatcacctcatgcagcccctcaggcttataaaactccaccggtgaactgcctttctcaaacgaaatcgtctcggcttcaatcagcgcgacatagcgcccgtttacttttgcgagatgaatagaatcgccaaaatccgctagcaatcccttaatctctgtttctccgactttcattttcagctgggcctctggcgtgtgctcgatgatttgggcggaggcttcgatgacttgatgggtgtcgaggcgctcttggatttcccgtttttcgcttgcttcccaaatctcaatgtcgtgctcgaactgcttgagttcttcgctgttgtcttcaaatgtctcgtagacgtgctcttgtaccatgttcatgacctgatttttcatgatttctggcatcgattctccgtactcgacgaatttcagaaagtcctcaaaatagcgggcgtgtgaggcctggtggattttcagttcaccttcctcgaccattccttcctctggcatgtacgggtattggatgcttttcatgttttttgtcgtgatcgccatttcgacttttttaatgagagaagacgcgtcagagatgcgggcgaccttcggctcaaaatcacatttcataatgaagacaaatgactcgtcaaagtattttctcggtacggccgaagcgacgagaaacacgccgccgcgaaccgcgcttgtgtcaaggtacgtgcggacgaactgctcgctcagctcattgaagtcttcttttgtttccgccagacgcgcgcggttgaacatgttgtagtttgggttggaatcgagctcgtggccgggctcgacgataaaatggccgattttcgtcggcacctgctcggactgcggatggcggtctgctttccgtttgacgatttttttcagttccccgtcgagaaagtccttcagctcgctttcttcaaattcgcccgtatcaagggtctggaagtgcttgaactgcttgttcgcctgctcatctttgccttccacctgtatgacataaaaggataaaaaccgaatttcaaaatccatatataaactcaccttattcgcgtattgtacagcttctcaagtatagaaaaaacagcgatcatgcgtcaattgggagaacggaataatcatgaccatgaaagggaaatgtagtcaaatagaaggcatctcatacggaaaggaatggttcgatgaaggaaacaagcccgattcctcaaccgaagacgtttgggccgctcggcaatttgcctttaatcgataaagacaagccgacgctttcgctgatcaaactggcggaagaacagggcccgatttttcaaatccatacacccgcgggcacgaccattgtagtgtccggccacgaattggtgaaagaggtttgtgatgaagaacggtttgataaaagcattgaaggcgccttggaaaaggtccgcgcgttttccggtgacggattgtttacgagctggacgcatgagcctaactggagaaaagcgcacaacattctgatgccgacgttcagccagcgggccatgaaggactatcatgagaaaatggtcgatatcgctgttcagctcattcaaaaatgggcaaggctcaatccgaatgaagcagtcgatgtcccgggagatatgacccggctgacgctcgacaccattgggctatgcgggtttaactaccgctttaacagttactacagagaaacgccccacccgtttatcaacagcatggtgcgggcgcttgatgaagcgatgcatcaaatgcagcggcttgatgttcaagataagcttatggtcagaacaaagcggcaattccgccatgatattcaaacgatgttttcgttagtcgacagcattattgcagagcgcagggcgaatggagaccaggatgaaaaagatttgctcgcccgcatgctgaatgtggaagatccggaaacgggtgaaaagctcgacgacgaaaatatccgctttcaaatcattacgtttttgattgccggccatgaaacaacgagcggcctgctttcctttgcgacttattttttattgaagcatcctgacaaactgaaaaaggcgtatgaagaggtcgatcgggtgctgacggatgcagcgccgacctataaacaagtgctggagcttacatacatacggatgattttaaatgaatcactgcgcttatggccgacagctccggctttcagcctttatccaaaagcagacacagtcattggcgggaaattcccgatcacgacgaatgacagaatttctgtgctgattccgcagcttcatcgtgatcgagacgcttggggaaaggacgcagaagaattccggccggaacggtttgagcatcaggaccaagtgcctcatcatgcgtacaaaccattcggaaatggacaacgggcctgtatcggcatgcagtttgcccttcatgaagccacacttgtgttaggcatgattctaaaatatttcacactgattgatcatgagaattatgagcttgatatcaaacaaaccttaacacttaagccgggcgattttcacatcagggttcaaagccgtcatcaggaagccattcatgcggacgtccaggcagctgaaaaagccgcgcctgatgagcaaaaggagaaaacggaagcaaagggtgcatcggtcatcggtcttaacaaccgcccgcttctcgtgctgtacggctcagataccggcaccgcagaaggcgtcgcccgggagcttgctgatactgccagtcttcacggcgtaaggacagagacagcacctctgaacgaccggattggaaagctgccgaaagagggagcggttgtcattgtgacctcgtcttataatggaaaaccgccaagcaatgccggacagttcgtgcagtggcttcaagaaatcaaaccgggtgagcttgagggcgtccattacgcggtatttggctgcggcgaccacaactgggcgagcacgtatcaatacgtgccgagattcattgatgagcagcttgcggagaaaggcgcgactcggttttctgcgcgcgggaaggggatgtgagcggtgattttgaagggcagcttgacgagtggaaaaaaagcatgtgggcagacgccattaaggcattcggactggagctgaatgaaaacgccgataaggaacgaagcacgctaagccttcagtttgtcagagggctgggcgagtctccgctcgctagatcgtacgaagcctctcacgcatccattgccgaaaatcgtgaactccagtccgcagacagcgatcgaagcactcgccatatcgaaattgcattgccgccggatgttgaatatcaagagggcgaccatcttggcgtattgccaaaaaacagccaaaccaatgtcaaccggattctccacagattcggtctgaagggaaccgatcaagtgacattgtctgcaagcggccacagtgcggggcatctgccattgggccgtcctgtcagcctgcatgatcttctcagctacagcgtcgaggtgcaggaagcagccacaagagcgcaaatacgtgaactggccgcttttacagtgtgtccgccgcataagcgcgaattagaagaactgacagcagagggtgtttatcaggagcaaatattgaaaaaacgaatttccatgctggatctgcttgaaaagtatgaagcgtgcgacatgccgtttgaacgatttttagagcttttacggccgttaaaaccgagatattattcgatttcaagctctccaagagtgaatccgcggcaagcatcgatcacagtcggtgtcgtgcgtggccctgcgtggagcggccgtggcgaatacaggggcgtggcatcaaatgatttagctgagcgtaaagccggtgatgatgtcgtgatgtttgtccgcacaccggaatcccggtttcagcttccagaagatcctgaaactccaatcattatggtcggaccaggcaccggagtcgcaccattccgcggtttccttcaagcccgcgaagttttaaagcgggaagggaaaacgctcggtgaagctcatctctattttggatgcaggaacgatcgtgattttatataccgcgatgaacttgagcagtttgaaaaagacggaatcgtcactgtccacacagccttttcccgcaaagaaggcatgccgaaaacgtatgtccagcatgtaatggctgaccatgcagaaatgttaatatcgatccttgaccgcggaggcaggctttatgtatgcggtgatggcagcaaaatggccccggatgtggaggcggcactgcaaaaggcgtatcagtctgttcatggcaccggggagcaagaagcgcaaaactggctgagacatctgcaggataccggtatgtacaccaaagatgtctgggcagggatatagataaagaagactgggaacatccagtcttttttgtcctttagaaaaaatggtgatcgcgctaaacattgatgcatacaataacttcagtccgccggaagggcgggctgtctgcaaaacctatttttcgtttttgctagtttatgttattcttatactcggtatctatttcttttttcaaaggcacacatgacaaaagaaatcctttttttatttccgagaaaaaaatgtgaaacgaaatgaaggtttctttcgtccagtgattggtttccaaatggttgtaataaaaatgatatggtgcgaaacataaatattccggcttgccgcggtgtatttcttgttgtgtgatgccttgattttgtttggaaagaaggaattggaaggcaggatataaagagcaggtaaatatgaatgaagaacttaaagtgtttaagaaagtagaggttgccatgaagaaacttttttcttacaaacttagcttttttgtgctggctgttatactgttttgggcaaaaacgtatttatcctacaagactgagtttaatcttggggtaaaaggcacaactcaggagatcctcctgatatttaacccattctcaagcgccgtcttctttttaggactggctttgctggcgaaagggcgtaaatcagccattattatgctgattatcgatttcttgatgacatttgtgttatatgcaaatattttattctatcgtttctttgacgatttcttgacgttcccgaacattaaacagtccggaaacgttggaaacatgggagacgggattttcagtatcatggccggtcatgatattttctatttcttagatattatcattttgattgcggtattgatctggagacctgaattaaaagaatacaaaatgaaaaaacgctttgcatctttagtgatcctttctgggatcgcactgtttttcatcaacctgcactatgcggaaaaagaccgtccgcagctgctgacaagaacgtttgaccgcaattatattgtgaaatatttaggtttatacaactacaccatttatgacggtgtacagacggctcaaacagaaacgcaacgggcctatgcaagcagcgatgatttaacaagcgtcgagaattacacgacgtctcattatgcgaaaccgaacgccgagtacttcggctctgccaaaggcaaaaatatcattaaaattcacctcgaaagcttccagtcattcctgattgactacaagctaaacggtgaagaggtgacgcctttcttaaataagcttgcgcacggcggggaagatgtgacgtattttgataacttcttccatcagacaggccagggaaaaacatctgatgccgagctgacaatggataactcgatcttcggtcttcctgaaggctccgcgtttgtgacgaaaggcgaaaacacttaccagtcgcttcctgcgattttagaccagaaggaaggctatacaagcgccgtcctgcatggtgattacaaatcgttctggaaccgtgaccagatttacaaacatatcggatatgacaagttcttcgacgcaagcacgtatgatatgtcagatgaaaatgtgattaatatggggcttaaggataagccgttctttacagaatcgattccaaagcttgaatctcttaaacagccgttttatgcgcatttgattacattgacaaaccattatccgtttaaccttgatgaaaaagacgcgtctcttaaaaaagcgacaacaggcgataacacagttgacagctacttccagacagcgcgttatcttgacgaagcgcttgagcaattcttcaaggagttgaaggaagccggcctgtatgacaactcagtcatcatgatttacggtgaccataacggtatttctgaaaaccataaccgagcgatgaaagagattcttggaaaagagatcacagattatcaaaacgcacagaaccagcgtgtgccgctgatgatccgcgttcctggcaaaaaaggcggagtgaaccatacgtatggcggcgaaattgacgttatgccgacacttctgcacttagaaggaattgattctcagaaatatatcaactttggtactgatttattctctaaagaccacgacgatacggtggcattcagaaacggagacttcgtaacgccgaagtacacatcagtcgacaatatcatttacgatacgaagacaggtgaaaaactgaaagcgaatgaagaaacgaagaatctgaaaacaagagtgacccagcagctgagtctttcagacagtgtcctgtacaaagacttgctgaggttccataaactaagtgatttcacagccgttgatccgtctgactatcattacggcaaggaaaaagaaatcaaataaagatgagaaagagccttgagcgggcgcattgccttcgctgaaggctcttttttttggttacataaccaacttcaaaaaatagattctatttggtcaccaaggccgtctttctctcatatcattacagtagattttgaaaccggattgaaatcggacaaattatcggggaaatgccttgatagattgtgaagatgtaccaggtttcgaactcaatattcatagagatgaggggtagagatgaaagcggtcattctctgcggcggaaaaggaacgagaatgagtgaagtcacgaatgacattcctaaaccgctcgccatgataggcggcaaaccgattctatggcatattatgaaaatttatcagtactacggagtaaacgagtttattctgcttttgggctataaaggagaaaaaatcaaggaatactttctcgactatgaatggaagcacaacagcctgacactcgacagctctacgggagaggtacagatgctggggcagcctgaaacgtggaaaattacgtttttggagactggggaagatacgctgacagccggaagaatcttgcaggcgaaagactatatcggtgatgaaacatttctgcttacctatggggacgggctggccaatatcaatcttttccatctcatcagctatcatcagacaaaaggtgctgccgcgactgtcaccggcattgacaaagtctcgcagtttggcaccttgacggttgaggacggcatggcgaaaacattttctgagaagacatcaagtgacggaatcatcaacggcggattcttcgttctcagtccaaaggttttcgattatttgccgaaggacggaaacacgatgttcgaagatgaaccgctgaagaaccttgccaaagacggggagcttgctgtgtaccgccattacggattttggacggccattgatacgtataaaaatctcttagaagtcaacaaaatgtggaatcaaggacaacaagtatggaaggtatggtgaatcgatttgagtttctggaaaaataaaaacgtatttgtcacgggatgcacaggtcttttaggaagctatttggtgaaagagctgattgaacagggcgcaaacgttacggggcttgtcagggatcatgtgcctcaatccaatctttatcagggagaacatatcaagaaaatgaacatcgtgcggggctctcttgaggacttggctgtgattgaacgcgcgcttggcgagtatgagatcgacactgtctttcatcttgctgcacaagcgattgtcggcgtggcaaaccgcaacccgatttctacctttgaagcgaatatcctcggcacatggaatattctcgaagcctgccgcaagcatccgttaattaagcgggtcattgtcgcttcaagtgataaagcttacggcgatcaagaaaaccttccatacgatgaaaacatgccgctgcaaggcaagcacccgtacgacgtctcaaaaagctgcgcagatctgatcagccacacctattttcacacgtacgggcttccggtctgcattacgcgctgcggaaacttatacggcggcggagatttgaacttcaaccgcatcattcctcagacgattcagcttgtgctgaacggggaagcgccggaaatccgaagcgacggtacctttgtacgggactacttctatattgaagacgccgttcaggcttatctgcttcttgcagaaaaaatggaagaaaacaatcttgccggagaggcctttaacttcagcaatgagatccagctgaccgtacttgaactggtagagaaaatattaaagaaaatgaacagtaatctgaaacctaaggtgctgaatcagggaagcaatgaaatcaaacatcaatatttatccgcggaaaaagcaagaaagctgctgaattggacaccggcctacactattgatgagggacttgaaaaaacgattgagtggtatacggaattcttcaaaaagtaatgtgaaacgaggtgaacaagactgtgaccagcgcgtattgcaccgttttatcaaaaggaagattatatcaggcagtcgctttgtttaagtcgttagagcaagttgatcaagacagtcccatttttatactttgcatggatgaagatacgcaccgcgtgttacagaagctgaagatgaagcagctgaaccttgtgccggtggccgctcttgaaaatgaattgctgctgaagctgaaggaaactagagatcaaagtgagtattgctggacgatgaagccgatctttctgcaagctgtgctgaacagcaatcctgagctggagcgtgtgacgtatattgacggggatctctttttctatgcagatccatcgccgatttttgaaaaccagccggactgctcggtgctgctttcacggggggatattgtaatcccttcttttgagaaagagcagattgacatgctgcagcgtcttttaggcagatataattccgggtttatcagcttcaagcatgatgatgcaggcacggattgcttggagtggtggaaggaacgctgtcttgaggaatgcaaaaatgcaccgggtgaagggaaattcggtgatcagggctatttggattatatgtctgagctgtttccgaatgtgtgtgacattacaacacccggcgtgaacattgggcattggaattatgggcatcatacgttttcctggaaagatggccggatcgtgctggaggatggcagtccgctgatcttttatcatttcagcggataccgaatcgtcagcatcaatgaaatcaaacagattcatgaaacaacccgcacagatctgccgtttgtgcatgaactgtatcaagagacactgccgcatatcattcagcacatgaaaacgttagaccctgaatttaacggttttgcttcaaaagatgacaacaaataaatgagtaaatacaggaagtgaaaatgaagtgaaagcaagcgttattattcctgcatataattcgaaggagcgtctttacaacagccttctgtcattaaaccagcaggagtgcgatgaagaattcgaagtcattgtagcggacaatggctctgaggacgggacgctctcgatgcttgagtcatttcaagctgattttccgctgatctttacacggattaaagaaaacaggggcattgcgtacggacgaaatcaggcgcttcgcaatgccagaggagacatcctgattttccatgacagcgatatgcttgcggcaaaggaccttgtggcaaaacatattaaagcccatgagaacgaagagaatctcgtcgtgtgcgggttgttttggaaacggatctacagtttttattatgaacggtttgaagaagaacataaggaacagctcgcaaagctcacaggtgaaatgccgaagaaagacaaacaaaagctgctggaggaagcggacatcaaaaacggaagctttcttgataaaagctttgacctcgataccgactttatagacgtgctcaagaagattttagatgagtacggcgatgacttgaaaggctatcatatgccatggcgcttttttatcacgaataattcctctgtgaaacgcaagcatgtggttgacctcggtttatttgacgaaggcattgtgcggtacgggtttgaggattatgacctcgggatcaggcttcatcaggccggattgaccttcaggcttcgccgcgatattgtcagtgttcatcaggaacatccaagcaattgtaagtctgtagacgatattcgggcaaacattgcctatatgtgcgataaatacaataacatccgctccttagacgttcatctcgcatttaatgggccgttcccgcctgacatgacgaacagaatcatggctgatattcaaaagctgctggaatcacagaaatatgatatgctgctgaatctgtttcttgagcttctgcatgttgttaaagagcgcaacattgatccggattggagaaagaaatccccaagggtgacggcgaaaagctttgatttacaaactgtccgcaagcttctgccgaaagcgaagaaaaagctaggcgtgaacgattttgccaacgcactgtatgcgcttgtcaacgatttgctgcacgtggatcttagatcattggatgtggtataagtgagtacatttcatttttcaacgatagtgtcaaggacacatatctttaagctcatgcctatgattcattctctccatgagcattgcgatgattttcatttatatgtgctgtgtgtcgaccagaaagcgtatgaattgcttcagcatgttccatgggagcatgtcacctttgtgcagctgcatgaaatggaagacccggagctgctgaaagcgaaaagcaacagaacgtttcatgaatattgctggacgttaaagcccgcctttttgtttcatgtgatgagcaagtgggatgacgctgaatactttgcccatatggatacggatctatttttcttttctgatccggcgcgtatttttgcagaaaacccaacggcgtctctgtatttgactgatcatcgtaactcgccgcgcttcatgtcctactacgaccgaaccggacgctttaatacaggctttgtcggtgccggtaatacaaaggaagcatatgaagcggtgtggcagtggagacaggactgtattgaattttgtacggtcgaaatggatacggaacgaaagacatatggtgatcaaaggtatgtggagaaatggccggcgcagtttaaaggtgttcatgttgtcaaatcaataggagccaatacagcgctttggaatatcgaaaactataaggtcgggcaaaaggacggccgcgtgtatatagatgaaacgccgctgattttctatcatttctcagggtttacactggtgacagaaaaagagtttaatctttgctggtactaccggattgaagacgaagcgacaattgagatgatttatatgccgtatatattaaatctgaaaagatggattgatgaaatacagtcggcgtttccggactttgcggatggctttatcccgaagcacgcagtgcctgacactcattttatccagctggattaaaaaacccctgccgcctggcaggggttttttcagctatgccattctctcagcttctggtcactcggcaataggaaggcaaggatgccgagaacagggagaaaagcaatggcgatcatcgtgggggtcagtcccgcggcgtcaatcagagcgcccagcgccacagcgccgattgcgcccatcccaaaggcaagcccgacggttaaaccggacattgtgccgatttttccaggaactagctcctgtgcgtagacgaccgttacagaaaagctcgacatcagaaccaagccaatcaatgcgagcacgccataggcgagaaccgggccggcaaatggcagcacaatcgccagcggcgccgagcataacagcgaaccgaggataacgaagcgttttccaaaacggtctgcaagcgggccgccgagaaacgtgccgattgcgccgaacagcaagaagacaaaaatatagctttgtgcctgctgaatgcttacgtgatatgtatccatcgcgtaaaacgtgtaaaagttaccgatcgcactcgtataccaagaacgagcaaaaatgagaaatataataataataagagcagatacaacagatttggtgatggccgtgttttcagccgttttcttttgcttgcctgatttctgggcaaggctgccgagacgtgaggcgtaccatttcgcaatatacatgagaaacaaaacagcaagcgcggcgacgagcgtgaaccaaacagcgccgaattgcccgagcggcacaaggatcagcgcggtgatcagcggcgccatcgcctggcctgagtttccgcccacctgataaatcgactgggcgagcccgcgttttgtgccggcggccatatacgccacacgggagccctccggatggaaaatggccgagcctaatccaatgaaaaacacacagcataagatcgttatgaatgacggggcaaatgcaaggcctaaaatgccaagcatgctggcggtcaaaccgactggcagcgcatacggccgcggccgtttatcggtataccagccgacaacaggctgcatgacggatgacaccatgtttaatgtgaaagcgatgatgccgagctgtgtaaacgtcaggctcatggagcgttccaaaatagggaacatggccggaatcacagcttgaagcgaatcgttgagcatatggcagattccgataataatcaaaatcggatacaccgtggtgcctggtttttgaactgttttttcttttaacggggcggcgatagccaattgagtctcctccttacatatataaccaaagcataccaccatattattcataaggtgaagaatttatcaagaggaaaaaagactcttatgaaagaaacgccgtcagcctgattagcagctgacggtattttcgatattcaaaatgtgatatagctcttcaagcttacgaatctcataggttggtatgatctctggcacattcggcttcatgtcagggttcatccagcaagtatcaagcccggcgagctgtccgcctttgatatcagcagttagtgaatccccgatgattaatgtgtgctctgctgaaaattgaggaatccgttcaaacacgtaatcgaaatattccttcatcggcttttggaagcctgtgtcttcagaaacgaaaatgtccttgaagaatggaaataatcctgaatcacggaggcgcttatattgtgtgttagacacgccgtttgtcacgatgtacaaatcaaactgttgctgcagatttgagatgagatcaaatgcaccgtcaataagctgatgtccttcttcaagaaagcggcggtatttttgctcaagcaaggcgccgtccgcctcgtaaccgtactccttgagcaaagcggaaaaacgcgtgtttacgacttcatcccttgtcatcttaccttcttcaaaggctctccagagaccttgattgatggttttatactgcgccttcatgtcatttgttaaaggaatgttctgatcttcaaacagcaaacgcagggctaaagcttctgccgcttgaaaatcaaggatggtatcatctacatcaaataataaagtgcggtatcgtttcatctgtgtgtctccctttcctcatatgtattcaaagtatagcacataaaaaaaggaaaaagccggcgggtgaggcaccgccggctaaaaagagattatttgtttaataagctgtgttttctcgaatataggaagtaaaccagcgttccgacagcgatccagatgacaaatgaaagccatgtgacgccgggaaggctgtacatgaaccaaatgcagatgcctgcgctgataatcggcacaaccggaacgaacggcactctgaaggacgccttgatttcaggatgtttctttcttagcacaatgacagcaatagatatgaccgtaaacgcggcaagtgttcccatgttcaccagatgggccagcgttccgaggttaataaagccggcgattcccgctgcaacgattcctgtcagccatgtgttgcggaacggggttttaaatgacggatgaacctttgcgaacaatccaggcagaaggccgtctctgctcatggcaaatgtcaaacgaacctgagcgtacagcaaagcgagcatcaccgtcgtaatcccgataatcgcaccgacagaaataattccggcaacagcgtcctgtccgacgaatttcagcgcaaaggatacaggatctccgacattcaatttggcataaggcatcatgcctgtcagcacaagcgataccgcgatgtacagaaccgtacagacggctagagctgaaataatgccgacgggcatgtttttttgcggatttttcacttcctctgaagcgttagaaaccgcgtcaaacccaaggtacgcgaagaatacagtggcagcgctaagaatgacgcctttcatcccgaatggcataaaaggagaccagttgtccggtttcacatagccgataccgacaataatgaacaataaaatgatcgcgattttcatcagtacgatgacgttgttaaagcgtgtgctttccttgacgcctctgctgacaatcgcagtgatgaggagaatgatcaccgcagccggaagattaaatacggcgcccgccgtgcttcccggcgctcctgtcagtgcagccggaatatgaagattgaagccggcaagcagtgattgaaagtatgaagaccagccggtggcaaccgccgacagtgcaatgacatattcaagcatgagatcccatccgatcaaaaaggcgagcagctctccaagtgtcacgtatgagtatgagtatacgcttcccgaaatcggaattgaagacgaaaactcagcataacagaaagcagccagcgcacaggcgagccccgctaaaataaacgatatgatgagggcgggacctgcaccggtcgctgccactgttcctgtaatgacaaaaatccctgtaccgatgacacaaccgataccgagcaaggttaaatcaaatgcgcttaacgtacgggcaaggctttttgacttgctctgcgcactcaatgtttcaagcggtttttttctaaataatgaactcatcaaaagttcctcctggaaatattcaaaatattctaatcattatatacagttcttgttgtattatattgtcgaaatttgacgcagtcaataaaatatttttctgctttaaatgatagaagcgaaacagcgttgtcgtatcataggatagtaatttttactaatcgtatattcaattttatgcaagatgaaccgatagaaaaaatagattcgcccatattttgatttgcggttataaaggagatgctgaccatgtttcaatatgaagagttgaataaacagtttatcggcgggaaatggcaggagggcagcagcccaaatgtattggaaaacaaaaatccttatactcaaaaaacattcacaacattccgtaaagcgactgctgacgatgtagatgaagcgtatcgggcagcggcgctggcaaagaaaaaatgggatgcggtcaacccgtttgagaaaagaaccattttagaaaaagccgtcacgtatattgaagaaaatgaagaagccattatttatttgattatggaggagctaggcggtacaaggctcaaagcggcttttgaaatcggacttgtcaaaaacatcatgaaagaagcggcaacgttcccaattcgcatggaggggaaaattcttccgtccacaatagatggcaaggaaaacagattatatcgcgtgccggcaggcgttgtcggtgtcatcagtccgtttaacttcccattctttttatctatgaaatcagtggcgcctgcactcggagccggcaatggcgttgtgctaaagccgcatgaggaaacgccgatttgcggcggaacgctgattgcgaaaatttttgagaacgcgggaattccagcggggctgctgaatgttgttgtcacagacattgctgaaatcggcgacagcttcgttgagcatccagtgccgcggatcatctcatttaccggttctacgaaagtcggcagctacatcggacagcttgcgatgaagcattttaaaaagccgcttcttgagcttggcgggaacagcgccttcatcgtacttgaggatgcagatatagaatatgcggtcaatgcggcggtgttcagccgatttacacatcaaggacagatttgcatgtcagccaaccgcgtgcttgttcattcttctatttatgacaagttccttgagctgtaccaggcaaaagtggaatcgctgaaagtcggcgacccaatggaccctgatacgattatcgggccattaatcaacagcagacagacggacgggctgatgaagactgtagagcaagcaattgaagaaggcgctgtaccagtgaagcttggcggatttaacgggacgatcgtggaaccgacgatcttaaaagacgtcaaaccgttcatgagcattgccaaggaagagctgttcggaccggtcgtctcctttatgaagtttgattcagaagacgaagcggtggatatcgcaaacgaaaccccgtttggcttgagcggtgccgtacatacgtcaaatcttgagcgcggcgtggcttttgcgaaacgcattgaaacaggcatgattcacgtcaatgacacgaccatcaatgatgaaccgaatgtagccttcggcggtgaaaagcaatcaggcctcggccgtttaaacggtgagtggagcctcgaagaatttacaacgctgaaatggatctcggtccagcacgaaaaacgcagattcccttattaatgaaaaggagtgaatggaattgaccataaatacggaaaaagaaaccgcagatattctggacgcatttatcaaagtagccccttatttaaacagcctggttcaggatgatattacaatcggcatttatgatacggaaaaactgctcgtgaatataccggctaaaaccttttcgctgaacgtaaaagccggcgatccgctgcaggaaggggatatcatcacagatgccatccgcagcaatcagaagaagacgagcatggttccgaaagaattgttcggcttcccattgatcgcgcgtgccatcccgctgcacgacgagaatggaagagtcattggaggcgtcggcctcggaacgagccttgaggagtcgtcaaagctgcatgatgtggcggaaagcttatcagctgtcgttgaacaaacagccgcggctatttccgacatttctgaatcaattaacgggttttcaactcaaatgtcgggcatttcctctcaggcgaaaaaagtaagcgaaagcgccggtgaaatcgccgatatttcagtaactgttaaaggcatctcggaccaaagcaatctgctcggcttgaatgccgcgatcgaagcggcaagagcaggggagtccggaaaaggcttctctgtcgtcgcagatgagatcagaaagctagcaacgcattcaaaagaaaatgtcggccaaattgaccagattacgaaaaaaatccacagcctgctgaaagggctcgaggaatccattgagtcgattaaccagcatacagacggacaagccgctgctgttgaacaaatttccgccacgatgcaggagatttcaggaagcgcgcagcatcttgcaaaaatggccgaaaaagcgcttgaggaagagtaagagaccggggacaaatgtccccggtctttttctatcctgcatttccatgaaattcgtctgacgttttactagttttattccagcggctgatttaaaatgtacacatgaacttacgtgaggattgataggaaccatgagcatattaaaagcggaaaatctttataaaacatacggagataaaacattatttgaccatatctcctttcatattgaagagaatgagagaatcggattaatcgggccgaacggaacaggaaaatcaacgctgctgaaagtgatttccggcttggaatctatcgaagaaggagaaatcacgaaatctggaagcgtgcaggtcgaatttcttcatcaagacccggagctgcctgcggggcaaacagtgctggagcatatctattccggtgaatcggctgtgatgaaaaccttgcgtgaatatgaaaaagcgctgtatgaactggggaaagatcccgaaaatgaacagcgccagaaacacctgctggcagcacaagcgaaaatggacgcaaacaatgcatgggatgcaaacaccttggcaaaaaccgtattgtctaagctgggcgtcaaagacgtaacaaaaccggtcaatgagctctcaggcggccagaaaaaacgggtagccattgccaaaaacttaattcagcccgctgatctgctcattttggacgagccgacaaaccatttggataatgaaacgattgagtggcttgaagggtatttaagccaatatcccggcgccgtcatgctggtgacgcacgatagatatttcttaaaccgtgtcaccaaccgcatttatgagcttgaaagaggaagcctctacacgtacaaaggcaactatgaagtgtttttagaaaaacgcgcggaacgggaagcgcaggctgagcaaaaggaaacgaagcggcaaaacctgctgcgccgcgagctggcctggctcagacgaggagcgaaagcccgctccacaaaacaaaaggcgagaattgaccgggtagagacgcttaaagagcagaaaggccctcagtcatcaggttcactcgattttgccattggctcgcaccgtctcggaaaacaggttattgaagcggagaacgtcatgatcgcttatgacggccgcatgctcgtcgaccgttttaatgaacttgtcataccaggtgaacggatcgggatcatcgggccgaacggcatcgggaaaacaacgctgttaaatgcccttgccggccgtcatacgccggacggaggcgatattacgatcggacagacggtcagaatcggctactatactcaggatcatagtgaaatgaacggtgagttaaaggtcattgactatataaaagaaacagcggaggtcgtaaaaacggcagatggcgatatgattacagctgaacaaatgctcgagcgtttcctcttcccgcgttcgatgcagcagacgtatatccgcaagctgtccggcggggaaaaacgccgtttatacttgcttcaggttctcatgcaggagccgaatgtcctgtttctcgatgagccgacgaacgatttggatactgaaacattaagcgttcttgaggattatattgaccagttcccaggcgtcgtcatcaccgtatcccatgaccgctatttccttgaccgcgtcgtcgaccgtttgattgtatttgaaggaaatggtgtcatttcccgctttcaaggctcctacagcgactatatggaggagtcaaaagcgaaaaaagcggccccaaaaccggcagctgaggaaaaatcggctgaagccgagccgaagaaaaaacggaaaaagctttcttacaaagaccagctggaatgggacggcatcgaagataaaattgcccagctggaagaaaagcatgaacagctcgaagctgacatcgccgcagcaggcagtgattttggcaaaatccaagagctgatggccgagcaggcgaaaactgcggaagagcttgaggctgcgatggaccgctggacagaattgtccctcatgattgaagaactggaaagctaaaaagcgtggccgcagcaggccgcgctttttttcacataatggacaaaaacgaatcggcctgcttatgttaggataaaattgtgtgtcagcggcacatggaaaactaacggagatgatgaagtatgacatgggcgatcgtgatgttaattctcatgagtctggtgaaaatcgtattaacctgtcttcctacaggcgtcatagaatggctgctcggcaaatttgaagtgcacgccaagctgagtgacgaaaatgcgagtctctctctagatggaaaacgcctcgagggtgcagagaagcagaaagtgattgatcaatttaacgaagctatcttcctggaaaaatattatatctatccaggtgatgaagagcgttatttacatccggaaaacggcggcacgccgctggtgatagatacaaaaaaaggaaaaaaagacgtgaagctgttcgtgtaccgctacgacgaccatatcgacgtcgtgaaacagtacaagaagaaagtgatcgcgtatcgagtgctttctgaaagccttcaaaaagagtctctgtcagtggcgggaagtttagcttaaacaggaaagtgaaagacgggtgctttatgctgctcgtcttttttattgttttttaaaacttaacgtttacgttaaggttcaaaaggtgtataatggtaacagaaacggcgaagggggatttaccttggaatggatgaagattgatcaagtggccaaaagaagcgggctgacaaagcggaccatccggttttatgaagaaatcggcttgattccggcgccgaaacggacagacggcggtgtaaggctttattcagaggatgatatggaggagcttgagaaagtcatcagcacaaaagaggtgctcggtttttcccttcaggagcttcagcatttcatggaaaccagccgccagctagagttaaacaaagaggggtatttgttgtcactggatcctaaggaacggaaagaaaaactggaggaaattcaggaaaccctgaatcaccagctggatttgattgatgagaaaatccgcacattccaaagctttaaagaacgcctgcagggcatgaaaaataaagcggaacgcgccattcaatcaatcgaatgaaaagtttgccaaacgctatttttgtagcgtttcttttaatggaataaagatggaggtcaggtcaaatggataagacaaaacaagtgaatcagaaaacaggcttgctcagccagccgaaagcggtttgggctgtcgcgtttgcctgtgtgatttcctttatgggaatcgggctggttgatccaattcttccggccattgccgcacaattacatgcttcacctagtgaagtatcactcttgtttacaagttatttgcttgtaaccggatttatgatgtttttctcaggagccatttccagccgcatcggcgcgaaatggacattaattctcggacttatttttattattgtgtttgcggggcttggcggcagctcaagctcaatcgctcagttagtcggctatcgcggcggctggggattagggaatgctttgtttatttcaacagcgcttgcggtcatcgtcggcgtgtcagtcggcggcagcgcccaagcgattattttgtatgaggccgcgctcggtctagggatttctgtcgggccgcttgcaggcggagagcttggaagcatttcatggcgcgcaccgtttttcggagtatctgtcctgatgtttattgcgttaatcgcgatttctttcatgcttccgaagctgccgaaaccggcgaagcgcgtcggtgtgtttgatgcgatgaaggcgctcaaatataaaggccttttaacaatggcggtatcggcattcttatacaactttggattttttattttgcttgcttattctccgttcgttctggatttagatgaacacggtcttggatatgtcttcttcggctggggccttctgctggcgattacgtcagtctttacggcgccgctcgtgcacaaagcgctgggcacagtgcgttcgctcgtcgttctctttatcgcctttgcggccattctcgttattatggggatctggacagaccatcagactttgattattacatgtatcgttgtcgctggtgctgtcctcggtatggtgaatacgatcatgacaaccgctgtgatgggttctgcgccggttgaacgttcaatcgcgtcttcagcctacagctcagtccgcttcatcggcggcgcgctcgccccgtggattgcaggaatgctgtcagaacactttactgcaagcacaccatatacagtaggcggaatcgtcgtttttgtcggcatgcttgtccttctcatgggacgtaaacatcttgctggaattaaggcgggacattaataacgaaagacactgcgaagatgcagtgtctttttattcgttataatgcatcataatcgaattggtgaaggaaaggacaacctttatgacacaattttactatttttcgactgaaaactccctttagaaaccggttttttcggtcagcaagaacggcgttcgcggaaagggcatccgcttcggtcagacattgatgcggctgggatttatcttgcagaagctgagaatgtgtccgttcatttacgattgccatttcaagtgatggtttatgctgtagaggggacgtttgccatggataaggcaaaacctgacgaatatgatcataaatgtttagaaacgctctatcaatacatacacagcgtcatgaaaaacagcttttctcggtcgagtggtttaccgcttgggcagatgaggaggattttgagctgtctgccaaaagagagctgacacttgatgaattcacctcgccatagcagctcattttaaaagacagagagcttttgagaatcgttcagaaaaaatggcagtaaaaaacccgccctttagcaggcgggttatttataaattaaagcactttcgtcgtccaagactcgcagttccacgtttctgtcgcaatatccatataaaagtctggctcgtgggaaatgagcagaatggagcctttatattctttcagggcgcgcttgagctcttccttggcatcgacatccaagtggtttgtcggctcatcgagcaccagcaggtttgtttctgagttgattagcttgcacaatctgactttcgctttttcgcctccgcttaatacggagacgcggctttcgatatgctttgtcgtcagtccgcattttgccagagcggcacggatttcatactgcgtataagaagggaattcgctccatacttcttcgatgcacgtattgttgtttgtttccttgacctcttgctcgaaatagccggtatagatgtgctcaccgcgttcaacagagccctcaagcggctggatttcgccaagcaaacttttcagcaacgtcgtttttccgatcccgtttgcgccgtaaagggcgattttttggccgcgttccatgcggaggttgagcggacgggacagcggggaatcgtaaccgatcacgagatctttcgtttcaaaaatcagcttgcctgacgttctcgccggcttaaagtggaattccggctttggcttttctgccgcaagctcgatcatatccatcttatcgagtttcttttggcgggacatcgccatgtttctcgtgctgacacgcgctttgttgcgggcaacgaaatccttcagctccgcgacttcctgctgctgctttttgtaggccgcttcaagctgctgttttttcacttcgtagacttccataaactgatggtagtcgccgacatagcgtgtcagctcttgattttcaacgtgataaatcaggttgatgacgctgtttaagaacggaatatcgtgggaaatcaggatgaacgcgttctcgtattcctgcaggtagcgcttcagccattcaatatgctgttcatcaagatagttggtcggctcatcgagaagcagaatttccggcttttcaaggagaagcttagcgagaaggacctttgtgcgctgtccgccgctcaaatcggtgacatcgcgctctaatccgatatcgctcaaaccgagaccgcgggcgatttcttccaccttggaatcaatgacataaaaatcattgtttgtcagcgcgtcttgaatgacgccgacttcttcaagcagcttttcgagctcgtcgggatcagcctcgcccattttgttgtaaatctcgttcatttcctcttccatcgcaaataaataatggaatgcatctttcaggacgtcgcgaatagattttcctttttccagcacggtatgctgatcaaggtatccgacacggacattttttgaccattcgacttttccctcatcaggttcaagctttccggtaataatattcatgaaggttgattttccttcaccgtttgcgccgatcaagccgacgtgctcgccttttaacaggcggaaggaaacgttattaaaaatggcccggtccccgaagccgtggcttaaatcctttacagataaaatactcatgtttacacctctatcgttatcaaacacgcacaatcggcgtgtaatattcacccttttgattataaaggaggattcggaatgttgaaaggtataggaaagaaaaagaaaaattgcgttccgggcgaggttttgagatactatggaatagatttcaggaattgaggagaacaaaatgacgcaaacttggccatttttacataatgcacaatcatttatacaagagaattggaatgcttccggctttcaaacgccaacccctgttcaagagcaggcagcccagctgatcatggacggaaaggatgtcatcgcggaatcgccgacaggcacaggcaagacgctggcgtatgcgctgccggtcttggagcggatcaaaccagagcaaaagcatccgcaggcggtgattttagcgccttcccgtgagctggtcatgcagatttttcaggtgattcaggattggaaagcgggctcagagctgcgcgcggcttccttaatcggcggggcgaatgtgaagaagcaggtcgaaaagctgaagaaacatccgcatatcatcgtcggcacgccaggcagggtatttgaactgattaaagcgaagaaactcaaaatgcatgaagtgaaaacgattgtacttgatgaagcggatcagcttatcctgccggagcatcgcgagacgatcaaacaaattattaaaacgacattaagagaccgccagcttctatgtttttccgcgacactcaaaaaggaaacagaggatgtgctccgcgaattggcgcaagagcctgaggtgttgaaggtacagcgaagcagggcggaggcagggaaagtgaaacatcaatacctgatttgcgaccagcgcgacaaagtgaagctgctgcaaaagctgtcaaggcttgaaggcatgcaggcactcgtatttgtgagagacatcggcaacctgagtgtatatgcggaaaagctggcatatcaccacgttgaactcggcgttttgcacagtgaagcgaaaaaaatggagcgggcaaaaatcatttccgcattcgaagacggagagtttcctcttttattggcgactgacattgccgcacgcggtttagacattgaaaacctgccatacgtgattcatgctgatattccagatgaagatggctatgtccacagatcaggacgaacaggccgggccggaaaagaaggcaacgtgctgagccttgtgacaaaattggaggaatctaagctgaaaaaaatggcgaagaagcttggtgttgaactgagtgaagctgtgtatgcaggcggaaaactgaagacgaaataaaaaggagggcggaaagcccttcttttttgttgtaaaataatagaaaaagtttcgcgcagggggtgcgaaggtggtttcaatagacaggtttcaagcagtgaaggagtcagagctgaaaattcttgaacactggtttgagaatgaggataccagacggagaatggatgggatgctgccattagatgaatggtatgcacgagtaaataaagataaacacaatactgtcatcatggcgtatgatggacagctgccggcagggatggtcgttattgagttcggagaggagcggacgtatattggattgatcgtcaatcctttgtaccggcttcaagggtacggaaaagggatattgcaaaagctgatgactgaacctgattttactagagtgcgggaatgggtggcatgcattgaagaagacaatcgaatcagtttggcttgctttcaagcagcaggattcactttggaagatacggaacctgatgaagatggttttcttacgctgattcttcgcagctgacctcatctaaacacataaggagggcaaaaagccctcccgatttcatcttcagctcggatcgctgaccttgatcagctgtttccctttattttctcccttaaataaaccgagaaacgcgtcaggaatgttttcgaagccttctgtgatggtttcctcgtaatggagtttaccagccttcagccattgggccagctgttttgctccctcagaaaaacgatcggagtagtcgctaacgataaacccttgcatcagcgactttgttttaatgagttttgattgaacacgagggcccatgtcatctgcttcgctttctgcgttataggaagaaatggcgccgcacaccggaatgcgggcaaattcattgagcaggttcatcaccgcgtctgaaatcggtccgccgacattgtcaaaatacacatcgacaccgtcaggacaagcgtcttgaagcgctttttggatatcacccgctgttttgtaattgatggcttcgtcaaactgcagctcctgttttaagtagtcgattttttcatcagagcccgcgataccgacaactcgagcgcctttgattttggcaatttgcccgactgttgaaccaacggctcccgcagctccggagacaaccacggtttcgccttccttcgggcgtccgatgtccagcaatccgaagtatgctgttaagccggtcattcccaaaatgccgagataggccgaagcgggagcaaggcttgtatcaatttttcgcaaggcagactcgctcacagcggaaaattcctgccagctgagatttccgatgacgatatcgccttttttcagattgttcccgtctgacacaacttcagcgataaccccgccagaaagcgcttcatctaaagcgaacggctcaacatatgacttcgtatcctgcatacggccgcgcatataagggtcaaccgatacataaagcgttttgacaagcacttccccttgcttgggttcaggaaccggaatggtttcaaagcgaaagtcttcatgaacaggaataccttgtggacgtcttgctaattgaatttgctgctgagatgctgtcattttcatcctcctatcacttggttgacaccactgtaacatggacaggagaggaaatacaaaaggtaagctggcatacaaaaaaggagagggggctcctctccttttcatttcgcccgtaatttcgggcacagtcccgtcggcaggcacattggcttctggtcgatcgggcttctcatgatgcagcattccaagccgaagacttcacggaaaaatggctgggtgaacacatcttccggtgttccggcattgtagatttttccgtccagcacactgatcagatagtcagcatattgagcggcttggtttaaatcatggagcaccatgacaacggtgcggccatggtcgcggttcagctttttcagcagttcaagcacttcaatctggtgtgagatgtctaaatacgtggtcggctcatcaagcaaaagcaaatcagtgccttgcgcaagtgccatggaaatccaggctctttgtctttggccgcctgagagggcatcaagtgtccgatccttcagttcaatcatgcccgttgcttccagtgcccactctaccatgtcatgatcctcttgggtatgcttggataacagctttttgtgaggatgtctgccaaaatagcataattcctctaccgtcaatccttcaggagcctgaggagattgtggaagaatggccagtttttttgcgacttcttttgatggctggcggtggatgtcttttccttctagtagcactgtaccgcttttcggggccatcagcctggcgagcgatttgaggattgttgatttaccgcagccattagcgccgatgagcgcagtgatttttccttcttctatctttaaatcgactccgtcaataatcactgtactgtcatatgaaagagtgagctggtctgcagccagttttcccatggtatcctctccctactgtttcctcgcttcgaatttcaataaatataagaaataaggcgcgccgatcacggctgtcagtattccggcaggtatttcaaccggaggcatgatgccgcgccctaacgtatctgcaattaataatataatagcaccaatcaatgccgatgcaggcagtaaatatttagctttttctccggtaagccgtctggcgatatgcggagcaagcaagccgataaaaccgattgagccgacgacggctacacagcttcccgccagcgccaccgcggtgaaaatcaggatgaatctcagccggtttgcgttttctccgagaccctgtgcaagctcatccccgagtgacataagatccagcttcggtatgagtatgcagacgatcggaaaaagaatcaaaagccatggcgcaagcagcttgacttcctcccagtttcttccccagaggcttcctgtcagccaaatgagtgcagcattcacgtcgcctggaaacttgaccatcatatattgcattccggcgtggcagaccgcgcctaaagcaatgcctgataaagccagtgaagagggctgaatgctcttttttcgggctatcattaataatagtacagcaataatggcggctccggcaaatgcggagaacggaagcacgtataccggcgactcaggaaagatgagaatcacagccatcgctgcaagtccggagccttttgaaatgccgacaacgtccggggaagcgagcggatttcggatcacaccctgtaaaatcgctccggcagcggcaagcccagccccggccaaaatcgctaatatgatgcggggcagacgatattgctgggtgataaattcaaaggaatgatccaatcccagcagattcgtcactaccgcatcaggtgaaatgtataatgcaccgattccaatgctgatgacggacagaacgatcaaaatcacggccaatatgagtatcgccagcaaggggcgtttttgttttctggttgttttcttcatttcagatgccgccctttccttgccaaatataagaaaaacggcgttccgataatcgcggtgacaatgccgaccggtgattcataaggaaatgcaatccatctggccagaacatctgcgtacaccagcaaaatggcaccgaacagtgccgaaaacggaagcacgtattgataatgttctccgatcagcttgcggacaatatgcgggacgagcagcccgacaaagccaatcggcccggcgacggctacggaagcgccggaaaggattaaaataatcaaactgatcagaatccggatgccgttcatattttgtccaagcccttttgctgtttcgtctccgagaccgagaacagaaacagaaccggaaaatatgagggcaagcccgatgccaatgacagaaaacggagcgatggttatgacgtcctgccagttgctgccgtcgattgcgcctgtcatccagtacagaacatcctcacctgactcatttaaaataatgatggcctgtgtcatagaggagaggaacaagtgcacggccattcctgacagcgccagcttgacaggtgtcattccgccggatgaggcaatcatatacacaatcgcgccgcctgctgccgcacccgcaaaagcgaatataacagatgaatagggcgatgccggcagaatgacgagagaagcaacgacaaaaagcgatgcacccgcattcacaccgaaaatttggggtgaagccagagggtttctggtcatagcctgcatcagcgcccctgctacagctaggctggcgccgacaaaaacgccgattaatgtgcggggaaggcgaagagtagagatgatgagctgttcctttgaaccgtcccatacaaaaagatatttcaatgaatctatgatgccgatgtctgaggctcctactgaaagattcagcccaagcccaaatataaaaataatcagtgcaatgatgaacatcatcagtcttgatgatgagcgccgtttggctgaatgatacaacagtctcacttccttactgcgtctggttgcaaaaacgaagaagcaaggatttcccctcgcttctcatttgtcctatttattatacacttttttaagcacatctttggcgcttgtttcactagacttgatgcctctgaatcttgtccaagtgtcacggtccgcatcatagacttgtccatttttcaccgctttgagatttttccagagcgggttcgttttccactcgtctacaatggttttaccttcgttggctgagatgaacaaaatatcaggatcgattttgctcaattgctcgaggctgacctcttgataggcgttatctgacttcacagcgtgtgtaaagcctagcattttaaagatttctccgtcataggatgatgatgtatgaagctggaaggaatccgctcttgcaacgccgagaacgatgttgcggttttcatctttcggaagttcggcttttagatcgttgatgacttttttgtgctcggcaagcttttcttttccttcatcttctttatttaatgctttagcaatggtcgtaaagctgtcgatcgtttcgtcatatgtcgcttcacggctttttaattcaatcgtcggggcgatttttttcagctgtttataaatgtttttatggcgctcagcgtcagcgatgattaaatcaggcttcaaggaactgatgacctcaagattgggttcgctgcgtgtgcctacagatgtgtaatcaatggagctgccgacaagctttttaatcatatcttttttgttgtcatcggcgatgcccaccggcgtaatgccgagattgtgaacggcatccaagaatgaaagctcaagcacaaccacccgcttaggtgtgccgcttactgtcgtttttccttcttcgtcatggatcactctggaatccttagacttgctttcgccgcttccgttgttattctggcttgatgaacagccggatacaatgaggcaggcgagcaataaaacactcatgatggcaatcaacttgttagaataggtgcgcatgtcattcttccttttttcagatttagtaatgagaatcattatcacatgtaacactataatagcatggcttatcatgtcaatatttttttagtaaagaaagctgcgttttttactgctttctcatgaaagcatcatcagacacaaataagtggtatgcagcgttaccgtgtcttcgagacaaaaacgcatgggcgttggctttagaggtttcgaacatatcagcagtgacataaggaaggagagtgctgagataaccggacaatttcttttctatttcatctgttagtgcaaattcaatgtcgccgatattcatgataatcgagaaaacaaagtcgatatcgatatgaaaatgttcctcggcaaaaaccgcaagctcgtgaattcctggtgaacatccggcacgcttatggaaaatctgtttgactaaatcactcacaatccaagcattgtattgctgttctggtgaaaaatattgcattagacatacctcctgctcgtacggataaaggcagcatttcatggtcgtgtgctccgtgcagcggcttctctttaattttgacttttctgaaaatggtcccgttcctatcactttaccatggacggaaaataaatagctactaccattcttcctgtttttctattcaatgttctggaatctgtttcaggtacagacgatcgggtatggaagaaatatagaaaacatgaaggaggaatatcgacatgaaaccagttgtaaaagagtatacaaatgacgaacagctcatgaaggatgtagaggaattacagaaaatgggtgttgcgaaagaggatgtatacgtcttagctcacgacgatgacagaacggaacgcctggcagacaacacgaatgccaatacgatcggagccaaagaaacaggtttcaagcacgcggtgggaaatatcttcaataaaaaaggagacgagctccgcaataaaattcacgaaatcggtttttctgaagatgaagccgctcaatttgaaaaacgcttagatgaaggaaaagtgcttctctttgtgacagataacgaaaaagtgaaagcttgggcataaagcaaagaaaaaaccaaaaggccaatgtcggccttttggtttttttgcggtctttgcggtggtattttgcagaatgccgcaataggatagcggaacattttcggttctgaatgtccctcaatttgctattatatttttgtgataaattggaataaaatctcgcaaaatagaaaatgggggtacatagtggatgaaaaaagtgatgttagctacggctctgtttttaggattgacgccagctggcgcgaacgcagctgatttaggccaccagacgttgggatccaatgatggatggggcgcgtactcgactggcacgacaggcggatcaaaagcatcgtcctcaaatgtgtataccgtcagcaacagaaaccagcttgtctcggcattagggaaggaaacgaatacaacgccaaaaatcatttatatcaagggaacgattgacatgaacgtggatgacaatctgaagccgcttggtctaaatgactataaagatccggagtatgatttggacaaatatttgaaagcctatgatcctagcacatggggcaaaaaagagccgtcgggaacacaagaagaagcgagagcacgctctcagaaaaaccaaaaagcacgggtcatggtggatattcctgcaaacacgacgatcgtcggttcagggactaacgctaaagtcgtgggcggaaacttccaaatcaagagtgataacgtcattattcgcaacattgaattccaggatgcctatgactattttccgcaatgggatccgactgacggaagctcagggaactggaactcacaatacgacaacatcacgataaacggcggcacacacatctggattgatcactgtacatttaatgacggttcgcgtccggacagcacatcaccgaaatattatggaagaaaatatcagcaccatgacggccaaacggatgcttccaacggtgctaactatatcacgatgtcctacaactattatcacgatcatgataaaagctccattttcggatcaagtgacagcaaaacctccgatgacggcaaattaaaaattacgctgcatcataaccgctacaaaaatattgtccagcgcgcgccgagagtccgcttcgggcaagtgcacgtatacaacaactattatgaaggaagcacaagctcttcaagttatcctttcagctatgcatggggaatcggaaagtcatctaaaatctatgcccaaaacaatgtcattgacgtaccgggactgtcagctgctaaaacgatcagcgtattcagcgggggaacggctttatatgactccggcacgttgctgaacggcacacagatcaacgcatcggctgcaaacgggctgagctcttctgttggctggacgccgtctctgcatggatcgattgatgcttctgctaatgtgaaatcaaatgttataaatcaagcgggtgcgggtaaattaaattaagaaagtgaaaaacacaaagggtgctaacctttgtgttttttaattaattaaaatgtttattaacttagttaaggagtagaatggaaaaggggatcggaaaacaagtatataggaggagacctatttatggcttcagaaaaagacgcaggaaaacagtcagcagtaaagcttgttccattgcttattactgtcgctgtgggactaatcatctggtttattcccgctccgtccggacttgaacctaaagcttggcatttgtttgcgatttttgtagcgacaattatcggctttatctccaagcccttgccaatgggtgcaattgcaatttttgcattggcggttactgcactaactggaacactatccattgaggatacattaagcggattcgggaataagaccatttggcttatcgttatcgcattctttatttcccggggatttatcaaaaccgggctcggtgcgagaatttcgtatgtattcgttcagaaattcgggaaaaaaacccttggactttcttattcactgctattcagtgatttaatactttcacctgctattccaagtaatacggcgcgtgcaggaggcattatatttcctattatcagatcattatccgaaacattcggatcaagcccggcaaatggaacagagagaaaaatcggtgcattcttattaaaaaccggttttcaggggaatctgatcacatctgctatgttcctgacagcgatggcggcgaacccgctgattgccaagctggcccatgatgtcgcaggggtggacttaacatggacaagctgggcaattgccgcgattgtaccgggacttgtaagcttaatcatcacgccgcttgtgatttacaagctgtatccgccggaaatcaaagaaacaccggatgcggcgaaaatcgcaacagaaaaactgaaagaaatgggaccgttcaaaaaatcagagctttccatggttatcgtgtttcttttggtgctcgtgctgtggatttttggcggcagcttcaacatcgacgcaaccacaaccgcattgatcggtttgtccgttctcttattatcacaagttctgacttgggatgatattaagaaagaacagggcgcttgggatacgctcacttggtttgcggcgcttgtcatgctcgccaacttcttgaatgaattaggcatggtgtcttggttcagtaatgccatgaaatcatccgtatcagggttctcttggattgtggcattcatcattttaattgttgtgtattattactctcactatttctttgcaagtgcgacagcccacattagtgcgatgtattcagcatttttggctgtcgtcgtggcagcgggcgcaccgccgcttttagcagcgctgagcctcgcgttcatcagtaacctgttcgggtcaacgactcactacggttctggagcggctccggtcttcttcggagcaggctacatcccgcaaggcaaatggtggtccatcggatttatcctgtcgattgttcatatcatcgtatggcttgtgatcggcggattatggtggaaagtactaggaatatggtagaaagaaaaaggcagacgcggtctgcctttttttattttcactccttcgtaagaaaatggattttgaaaaatgagaaaattgcctgtgaaaaatggtatgatctaggtagaaaggacggctggtgctgtggtgaaaaagcggttccatttttccctgcaaacaaaaataatggggctgattgcggctctgctggtctttgtcattggtgtgctgaccattacgttagccgttcagcatacacagggagaacggagacaggcagagcagctggcggttcaaacagcgagaaccatttcctatatgccgccggttaaagagctcattgagagaaaaggcggacatgcggctcagacgcaagaggtcattgaacaaatgaaagaacagactggcgcgtttgccatttatgttttggacgaaaaaggagacattcgcagcgcctctggaaaaagcggattaaagaaactggagcgcagcagagaaattttgtttggcggttcgcatgtttctgaaacaaaagcggatggacgaagagtgatcagagggagcgcgccgattataaaagaacaaaagggatacagccaagtgatcggcagcgtgtctgttgattttctgcaaacggagacagagcaaagcatcaaaaagcatttgagaaatttgagtgtgattgctgtgcttgtactgctgctcggatttattggcgccgccgtgctggcgaaaagcatcagaaaggatacgctcgggcttgagccgcatgagatcgcggctctatatcgtgagagaaacgcaatgcttttcgcgattcgagaagggattattgccaccaatcgtgaaggcgtcgtcaccatgatgaacgtatcggcggccgagatgctgaagctgcccgagcctgtgatccatcttcctatagatgatgtcatgccgggagcagggctgatgtctgtgcttgaacaaggagaaatgctgccgaaccaggaggtaagcgtcaacgatcaagtgtttattatcaatacgaaagtgatgaatcaaggagggcaggcgtatgggattgtcgtcagcttcagggagaaaacagagctgaagaaactgatcgacacattgacagaggttcgcaaatattctgaggatctcagggcgcagactcatgaattttcaaataagctttatgcgattttagggctgcttgaacttggggagtatgatgaagccattgatctgattaaagaggaatatgcgatgcaaaatgaacagcatgatcttttattccataacattcattcgcagcaggtgcaggccattttgttagggaaaataagcaaggcatcggaaaagaaggtcaagctggtgattgatgagaacagctcactcgcgcctcttcctgcgcatatcggcttgtcccatcttattacgattattggcaatttaattgataacgctttcgaagctgtagcggagcaaagcgtgaaggaagttttgttttttatcacggatatgggccatgacattgtcattgaagtatcagacacagggcccggtgtgccgccagataagatggaagaagtgtttgagagaggctattcttcaaaggggatgaggagaggctacggtctggccaatgtgaaagactcagtgcgtgaactgggcggctggatcgaactggcgaatcaaaaaactggcggggcggtattcactgtgtttataccaaaggagaaacaaagggggaatccatttgattcacatcgcgattgcggaggatgattttcgagttgcgcaaatccatgagagattgatcaaacagcttgatggattcaagattatcggcaaggcggctaacgcaaaagagacattggcgcttttgaagggacacaaggctgatttgcttctgctggatatttatatgccggacgagcttgggaccgcgttgattcctgaaatacgaagccgatttcctgaagtggacattatgattatcacagcggcaacagaaacccggcatttgcaggaagcgctaagggcaggaattgcccactatttgatcaaacccgtaacggctgacaagttcaggcaggtgctgcttcagtataaagaaaaaaggaagctgctcatgtctcagccggaggtcagccaagccatgatcgaccatatttttgggaacagtgtgaagacagctttgccggcagaggatttgccgactggcattaattcgattacactgcgaaaaattaaggaagcgcttcagactgcgtcagaaggattgacagcggaggaacttggggaaaaaatgggggcgtcacgaacaactgcccgccgttatgccgagtaccttgtgtcaaaggaagaagcaagagccgagcttgaatacgggattatcggcaggccggagagaaaatattatttggcggcggattagatatgaaaaaatctataatcctattgattattctattgatctttatgcagggtgatatcaggcaggcggctgcgccgcgcctgccggacgggccgatagaaattgtcgtccctgccgaaccttctggcggctgggatgtcacagcgcaggcgatccaatctgttttgaggcagaagcagatcgtgaagggtgatgttcatatcgtctataaatccggcggcggggagagaaaggctggaaatatgtcaacaaaagcagcaaacaaaccatcagcatgacgtccagcctaatattgagcaatgatcttctcgggcaaagcaaattaaaaatggccgattttactccgctcgccattctctccaaggaatggcagacggttgcattgccaaaaggatcagcgttaacaaatggcaaggatgtgctgaatgagatcaacatgcatcccggcaaggtgagaatcggctttgccccgggtttggcaatgatgatcagctctcgttcgtcagagcggcagatatgtacggcattgacccgtttgacattcaattctcacagtatgacagcagtgaacagctcattcaggcgctgatcagacatgagatagaagcagcttccatgaccctttctgaagcgaaaccatatgaacgaaacggcgatatcacgttagccgctgtaacgtctgataaaagacttcccggttttccaaatgtaccgacgtggaaggagcagggaatcccgtttgttttttctcattggagagggattttgggcccgaaaaatatgtctgaggaagagatttcttactgggatcaagcgctaaagaaggtcacctcttcacctgaatggaagcggaaaataaacgaacaggactgggaaagcttttatttaaacagcagggaaacgaaacggtttttagaagagcaatctgctttttatcaaagcatcatgacaggaaattaagatcccggcatcccggattttttcatgccgaaaattgatcaaaaagaacaaaacggttttaaaaaattaaaaatacaaaaaaaccaaattatttacttgcggttggttttcccatacgatggcaaaaaggcaagacaaaaaggggagtaagggagaaaaaaatgtaagcggattcatttaagggggaatggatgtgttagcaatcttaggctttctcatgatgcttgtgtttatggcattgatcatgacaaaacggctttctgttttaacagcattggttttgacgccgattgtgtttgcgcttatcgccggatttggatttactgaagttggggacatgatgatttccgggattcagcaagtcgcgccgactgcggtcatgattatgtttgcgatcttatattttggaattatgattgatacaggcctgtttgatccaatggttggcaaaattttaagcatggtcaaaggagaccctttaaaaattgttgtcgggacagcggttcttacaatgctcgtcgccttggacggagatggctcgacaacgtacatgattacgacaagcgccatgcttccgctctatttgctgctaggcatccggccaattatcctggcgggaatcgcgggagtcggcatgggaatcatgaacacgattccatggggcggtgcgacgccgagggcggcgagtgcgctgggggttgatccagctgagcttacaggtccgatgattcctgttattgcaagcgggatgctttgtatggtggcggttgcgtatgtgcttggaaaagcggaacgaaagcgccttggtgtgattgaactgaaacagccagccaatgccaatgaaccggcggctgcggttgaagatgagtggaagcggccgaaactttggtggttcaatttattgttaacgctttctttaataggatgtttagtatcgggtaaagtcagtttaaccgtactgtttgtcattgcgttttgtattgcgctgattgtgaattatcccaatctcgagcatcagagacagcgcatcgcggcgcattccagcaacgtgctggctatcggttcaatgatttttgccgcgggggtgttcacggggattttgacaggcacgaaaatggttgatgaaatggcgatctcgctcgtgtccatgataccggaacaaatgggcggattgatcccggcgatcgttgctttaacaagcggcattttcacattcttgatgccgaatgacgcgtatttctacggggtgctgccgattttatcagaaacagctgtcgcatacggtgtggataaagtggaaattgccagagcctctattatcggccagccgattcatatgctgagtccgcttgtgccatccactcatttgcttgtcggactcgtcggagtttctattgatgaccatcaaaaattcgcattgaaatgggcggttctcgcagtgatcgtcatgacggctatcgctctattgatcggtgcgatctctatttccgtatgataattcaggcgtaatgacacacactaacggcatacaacattccggaggtgtcattatgagtgatccttatatgccgctgacttcagtcagaagcggaacggggttcgaagcggcaaaaggggtgcacggcctgactgtgcaaattgcgaatgtctattttattcagctgccttctgaacctcactcatttgttttaattgatgccggcatgcctcaatcagccggcatgattgtcaatgaagccaaacaaagattcggtgaagggtttcagctgaaggcgattatcctcacacacgggcactttgaccatattggggcaatcgaagagatccttgagcattgggatgtgcctgtttatgtccattctcgggaaatgccttatgtaacaggtaaagaggattatcctccggctcgtcctgacagcaagagcgggctggtcgccaagctgtcgccgctgtttccgcggcactccatcgatatttcctcacatgtccaggcactgccggaagacggttcagttccttttcttgacgagtggatgtggatcgcgacaccaggacacacgccgggccatatttcgttattccgcgatgacggccgcgtgcttgtagcaggtgatgctgttattacagtggaacaggagaaaatggctgacgtcttgatacaaaaacaggagcttcacggtccgccggcttatttcacgcctgacacagagacggccgcggagtccattctgaagctggccggtcttgaaccggaagcgttattgacagggcacggcataccgatgaccggcaaaaactttcgaagtgacttaactgaattggcaaatcggttatcgtctatttgacacccgcaccacgcgggtgttttttattgttttccaggaagttgcagaaaaatcatttgtcttgccgcttaaaaacgatacaatgaaaagcatgaagtgatgtgaaggggagagtttgttggaagaaaaagaaatactctggaacgaagcgaaagcgtttattgccgcatgctatcaggaattgggaaaggaggaggaagtgaaagaccgtctcgaggacattaaaagtgaaattgacctgaccggaagctatgtacatacgaaggaagagctggagcacggagcgaaaatggcttggagaaacagcaatcgctgcatcggcagattgttctggaattcgctgaatgttatcgacagacgagacgtccggacgaaggaggaagtgcgtgacgccctctttcaccatattgaaaccgccaccaataacggaaaaatcagaccgaccattacgattttccctccggaagagaagggtgaaaagcaagtcgagatctggaatcatcagctgatccggtatgctggatatgagtcagacggagaaagaatcggcgacccggcttcctgttccctgacagcagcttgcgaagagttcggctggcgcggagagcgaacggattttgacctgctgccgctcatttttcgcatgaaaggcgacgagcagcctgtctggtatgagctgccgcgttcacttgtgatcgaggttccaatcacacatccggacatcgagacgttttctgatttggagctgaagtggtacggcgtgcctattatttctgatatgaagcttgaggtcgggggcattcattataatgccgcgccatttaacggctggtatatgggcacggagatcggagcgagaaacctcgcagatgaaaagcggtacgacaagctcaaaaaagtagcgtccgtgatcggcatcgccgctgattacaatacggatttatggaaggatcaagcgctagttgaattgaataaagctgtgctgcactcgtataaaaagcagggtgtcagcatcgttgaccatcatacagcggcaagccagtttaaacggtttgaagaacaggaggaagaagcgggcagaaagctgacgggggactggacgtggctgattccgccaatttcacccgctgccactcatatcttccaccgctcctatgataactcaatcgttaagccgaactatttttatcaagataagccttatgagtaaacaatagaaaatcgatgatggccttcaaggctgcgggattcagtcacagagatgtcggtaacctttgagaaagggcttccgttctttacagcctcaacaaacgattgcagggcgttttccggaccctctgccaaaatctcgacacgcccgtcatcacggtttttgacccagccggccagttttcgcttatcagcttccatttgaacaaaatagcgaaagcccacaccttgaacccggccgtctacaatgattcggtattgaagcatgtaaaaaccaccttttctttttatgataatcaatcattttacaacctgtaaaggggatgtgtttgtatgaaaccagagcgctattcagttctttctcttaatctgggaaaaccgcagacgcttgaatatgacggaaagaaaatcgaaaccggcatcatgaagcggccggctgaatcagccgtcatgctgtatcgggagaattttgaaggagacggacaggcggaccttgtcaaccatggcggacctgataaggctgtctgtgtctacccggcggagcattatccgttttgggaagagttcctttcaagaccgctgtcaaatgccgcatttggagaaaatctgacggtcgcgggcctgactgaggagaatgtttgcatcggggatgtgttcaggcttgatgaagctgttgttcaggtcagccagccgcgccagccgtgtgtaaagctggcgaaaaagtttggtgtaaaagaaatcgtgctgaaggtccagcaaaccggctatacagggttttattttcgcgtgctggaggagggcagggtgtctcccggcgcgaaccttgaattgctgtccagaggagagaaaggcatatccgtccagttcgccaaccgcatcaactaccatgatgcaaaaaatctcaccgccattgaacggattttaagtgaggctgcactatcggaaagctggagagcgtcctttatgaaaaaaaaggacaggctgcagccggttgaatagaaaaaagccgcgcatatcaacgtgcgcggctttgccatatttaagattgttttttctttgattcaagcaggttggcaagaaaataggttttatagctttgaagctttcttccttcatggtgcgtgatcccctgcttttttagttctgccacataccagcctttactgccgtaatgcatgtcagaaaactcctttccctatctgatttcgaaacgattggcattgtaacatctataaaaagatgctgaaaagagatgcggggaaaactgagcctttcgcactagatgtacgaatgttcttctgtatgtatatgcggagcaaaagccgaatatgatttaatggccggttagtttgatcatgacaacgccaaatgtcataatggcgaaaacaatgccgatatatgtgagcatcccgttttttttcttaacgccgtaaacggtcataatgatgccttcaatgaaaaaaatgatgccgaaaataataaaccacatgcagataaaggctcctttcacagacataatagtagtgtagcatatctgaaagagccgggctgtgacaatatcaagaaagccgggcgcatatcgcccggctcatgttttattgtttatcaaccaatttgaccagaagctgtgccaaatgttctttctcaccttcgtctgcaacgctccaaagctcttgcagcagcatttcttcaccgttttgcggctcttcatgctttgcgaggtagtctcccaagatcgcagcgctttttacaagcttgccgtcatccaatcccagctttttgcctcggttgacttgttttttcaggtagcctttaaattcatcaaagtcttttaaaatgtcttcttttattgtgccatgcatcgcgttcatttcgttttcaatttggattttttcttgatctctgttcattgcaagacctcctcgtgcagaataatgatgttttacctgctattggaggaggttaaacctgccggaagcccggaatgtgttttacagtttcgtcaggataatcggttcatcttttgtgatgacgatcgtgtgttcaacttgggcaaccatgcttttatccggcgtcttgaacgtccagccgtctccagcttcaacaatcgtttctgctttcgttgaaataaacggttcaagcgcgatgactgtgccatttttgaacagtgcgttatcaaacggatcataatagttcatgatgtgattcggcgcttcatgcaggcttcgtccgattccgtggccggtcagggttttgatgacggtaaagccttgagagcgtgcttcatgataaacggctcttccgatctggttttggcgcttgcccgcttttgcctgctgaagccccttttgaaaagcgttttccgcgcattggcaaagcttatgaaggcgttcttctccttcaccgagcacaaatgagatgcctgtgtcggaatagaacccgccaaattcagcggagatgtcgatgttgacaagatcccctgcttttaaaattttggatgtgcttggtatgccgtgagccacttcatcatttacgctgatgcatgtcacacctggaaaatcatattccttctcaggagctgaaacggcgccgtgctcatcaagcacagcttttccgataaggtcaaggtcttttgtgctcatgccgggctctgccttccgcttcatttcttcacgcgcaagcgcgacgattcttccgatttttttcaggccttctaattcttgatcgtttgttacaatcatctgtcattcccgctttctttttaaataatctagattaagcttaccacaactgtcttaaaaataggaaacacacggacctgggaaaaaagaaatacccccgggaaaattggtatagatcactagatatcttatatggtatatttgaaaaaaaagggtatgagggggatgggtatgctttcatttttacaaaaactcgggaagtcatttatgctcccgattgcagttctgcctgcggttggaattatccttgcgcttggcagagaggatgtatttaatatcccgtttgtctatcaggcggggacggcggtttttgatcatctgccgcttatttttgcgatcggaattgccatcggcatttcaaaagacagcaatggggccgcgggtttatcaggggcgatatcgtatctgatgcttgacgcggcaacaaagacaattgataaaacaaataacatggcggtgtttgggggaattattgccggtttaattgccggttacacctataaccgcttcaaggataccaagctgcctgaatatctcgggttcttcagcggcagacggcttgtgccgattataacagccattattacgatcattttagcgggcatattcggagtcgtctggccgccgattcaatcgtgtataaactcgtttggagagtggatgctcgggctcggcggcatcggggcaggcatattcggccttttcaacaggctgttaattccgcttggccttcaccatgtgctgaacaatattttctggttccaatttggagaatataacggagtgacaggggatttggcgcgctttttcgcgaaagatccgacagcgggcacatatatgacgggattcttcccaatcatgatgttcggtcttccggcggcgtgtctggctatggttgtgactgcgaagccgtctaaacggaaagcgacggctggaatgatgattgggtttgctttaacggcgtttatcacaggaattacggaaccgattgagtttgcatttatgtttttatctccgcttttatacgctgttcacgcggtcttaaccgggttatctttatttatcgtcaactggctcggcatccgttcaggcttctctttttcagccggagctatcgattatgtgctcagctatggaatcgcggaaaaaccgctgcttctgcttttggtaggtatatgctatgcagcggtatactttatcgtgttttatgtactgattaaggctttgaatttaaaaacgcctggacgggaagacgatgatgtggatgaagtgctggatgaaaatactgttcaggatgtaaatgaaaacatcatgctgaaagggctcggcggaaaagaaaaccttcaaaccattgatcattgcgccacaaggctgcgactgactgtgaaggataccgctttggtggatgaagcgctgctaaagaaagcaggcgcaaaaggggttgtcaaatcagggggcaatcggttcaagtcattattggcccgaatgtggaatttgcggcggaagaattgagagctgctgtcaaataaaaaagcggagagggcaacctctccgctttttcttatttatcttcgttatcctttgacgtttcggaagaatcttcgtcatgttttgtgtaatcataatcagaaggattcaccttcttaaaacctttcggctcgtagaaccgcagcaggtctccgtttatgattttatcggacatttcaagttccttcttgacgagcgagtcttctgacttgtcgacttcggattcatcgagttcttttccggttttcgtgtcgtaatacttaccggatattttcgtgtacttcggtgaaataaagtctccgtttcggaacggaatcacttcacggtgttctttcgataaaatatcagaaccggacatcagatagtccttcgtatccactccgagcagatgcagaatggtaggagccacatcaacgtctccggcatatttatgaactttctcgcccttcacgccggcagcgtggataaagagcggcacccgttgaagctgggcgttgtcgtaatcagtgatttcatccttgccaagcactttcgccatcgctttattgtggttttcagagatgccgtagtggtctccgtacatcacaataatcgatttatcatataacccgtcttttttcagatcattgaagaattgttcaatggactgatcaaggtaatgggctgactggaagtagttatcgacgacagagtcaccaaagtctccagccgggaagtctgtatccccctcatccattccgaatgggaagtggttggaaagggtaatgaacttcgtatagaacggctgcggcaggctttccagcagcggcattgattctttgaagaacggtttgtctttcatgccgtagtttttcgtgttttcttcgttcatgtcatagtaggcagaatcaaagaatttatcaatgccttccgctttgtacatttcgttacggttccagaacgtctgcgtgttcccgtggaaagtagcagatgtgtaattcttagacttcagaatcgccggaacggattgcagcgtgttttgcgctttgtttacgaaaactgaaccttgagccagcgggtacagagagttttccatcataaattcagcatcagatgttttgccttgtcccgtttggtggaaaaagttatcaaagtagaacgtttcgttatcatgtgccagtttatttaagaacggtgtcacttctttgccgtcaattttatagtcgatgataaatgactgcaaagattcaagtgaaacgtaaatgacgttttttccttccgctttgccgaaatacacgttattcggcacatcgtaattggctttcatgtagttttctacttccgttacgtcgctggaatcggcaagcgcgcgctggctgttggacttgatattctgtacagcgtcataaatcgtgaaattgtatgttcccaagtatttcacaagatagttccggtcgaatgatcttgtcagcaattcaggacggtctgattccgcaactgccaggttgatcaagaacacaagaattgaagacgcaaaaataattcggaacgattttttgcttgacgtttcggcaggcttgtttactttgatcgccaagatgatcaggatgatcgtatcgataaagtaaaaggcgtcagtcggtctcatcagcgaaaatgcgctgtcaccgagttggccgccgtttgttttagcctgcataatgaccggaattgtaataaaatcattgaaaaatctgtagtacacaatgttggcgtacagtaaaaaagacattaaaaaatgaatcactataatggctgtctgctgtaattttttcttgaacaagagtccaaagccaagaaagaacaagcttgagctaagaggattcacaaaaagcaatattttttgtatcgtgttgtctattcctaagttgaagttcaggacataaccgacatacgttttgatccataacaggacgaccgcaattaagaagaaggccagtcctctttcttttataaatgttttcattgttacactccttttttccgatccagttcgagcgaaacgatagaaaaaacgaacgtatccaatataacacgaatcagcagattagaaaagtgaaaatcgtatgatggagaaagtggcgaaaaacgccgtcgaatcaacgtttcgctttgatattaccaaatgtaaaacaaggtatctttctagaaataaaggaataaaatggtacatcgggaattgtatgataaaatataaggtatagataaaaagaggtgaaatgatggatttttcccatattgtgtctgaagataaaattaagcgcgccatcaaagacggggactttcaaaacctcccgggaatggggaagccgctgccgaaggatgacgcggcacacttgccggaatcgctgcgcatgggctatcgtattttgaaaaacgcgggaatggcagaggacgagggcgctctcaaaaaagagcttatgaccatcgaccatttaatcgaaaagtgctatgacgaaaaagaacgcgagcaattaatcaggaaaaaatctgaaaagcaattgctgcttgataagcttgtcgacaaaaaaggcatgttttcaaagccagcatccgctttttataagaataaagtatatgaccggcttgaacggaacagaccttcttccagctgatttgtcttgtctgcaggatggcgattgataaaagccatcctttttatgttccaagttctatatcaaaaggtttatgtttttccatctatgggaaatgacccataaacgaaaaaagggtgatgggatggaacgtctattagtatggatagagcatatatctgattggctgtgggggccgccgctaatcatcctgctgacggggacggggttgtatttcactattttgctgaaaggttttcaatttcgctatcctttatacattttcaaacagactatcggcagcgtaggaaaaaagccgaagggagagggcacagtcacaccgcttcaggcattgacctcagccctcagttcaacgatcggtgcagcgaacattgtcggtgtgcccgccgctattatgtttggaggaccaggagcggttttttggatgtggcttattgccttatttgccatggcgattaagttttctgaaagtgttcttgctgttcattacagagaaaaaaatgagcagggtgaatacgtcgggggaccgatgtattacataacaaaagggctgcgcatgaaatggctcggcgtattcttctctgttgcgctgattgtggagctgattcccagcattatggttcagggaaattcggtttcagtctcgcttgccgagacgttttctttcaataaaatatacgcaggaatcggaattgcatttttgattgggttagtggtgataggaggggtaaagcggatcggaaaagtaacagagtttgtcgtgcctcttatggcaggggcatacgcaggtgccggtctcctgattgttctcatgaatctatcatcagtgccggcgtttttctctctcgtcttttcaaatgcgtttacctcttcttcagcagttggagggttcgcaggtgctgcgttggcggaaaccgttcgctggggatttgcccgcgggctttattctaatgaagccggaatgggaacagccccgattgcacatgcggcagcaatgactgatcatcctgtgcggcaagggttttggtctgtgatcggcattgtcattgacaccttgatcatctgcacgaccaccgcttttgtcgttcttgcatctggtgtctggacagggaagaacgcctcaattgacccggcagcactgacgacggctgcatttcagcattatttcggttctggcggagggtacttcgtttcggtttccctagtcttctttgtcgtatcaaccattatggttgtcattttttacggtgtaaagcaagctgaatttctgttcgggcggctggcaggacacgtgattaaattcgtttatttagcggctattatcataggtgccgcaggcggagcaaaagccatttggggctttttggacttagcattggcttttattctcgttccaaatgtgattgcgctgttgttattgagcagaaaggtaaaagcgctgtacaccgaattctttacatctgaacagtactacctgaaagatataagaaaaacaaaacagaatcctgtttatcaaacaaaagaagctaaaaattcctagtgctttgctttggcgctgaacaacgctttgctttttatgatcaaataaatgagtaaaggcagcaaaatagaaatcacttcattaatgattggtttgattctgttaaagtcgaagctgatttgtatgtaagaagaaccaaaagctgccggttggtgtatacatggctttcgggtcgtttttagagcgataggctgtaccacgatacttcactataatgacggaaatccaaaaggccgtgatgatcaggcctgaacgatccaagatacaatcattaccatggagcagacacaatttccgcatcagtactgtcccaataacaagagcgccgaggatgctgaccgtctgaccaacggttttcggcaggcgcactccctcttcacggagagcctcagctgtatggcggggaaagaaatcggctagcgggcagacgccgcgctgaacattataccctgaggctttcagtgaagccctctctcgatcctttgatggtcgattctgttattaacttttcaaagtttcttcataaacaataaatccgcacagcccatttccaaagtcaaattgtctaaatacgatgtttgagcaaccttctgtaagctgggtcagattatcgaggttttccttcaaattgggagagatcggtctgtcctgattgtcttcaagctctttgatgagctgaagcgctttgtcgcgtttattcatagaggctcaccctgctttttaatgtcatattcaataagtgcttgtgacttttagggtaaccttgtctgtttcatataatccagactaggatgaaagcgctataaaaaagtgttgactgcctgtatatacaggaatacaatatgattataagttgtatatacaagttataaaaacggatacggaggggttggcatgggggaactgaacaaatcggcacgtcagattgtcgaagcagtcggcggtgcagaaaatattgcagcggcaactcattgtgttacacgtttgcgttttgctttaatagatgaaagcaaggttgaccaagagatgcttgatcaaattgatgtggtaaagggatcattctcgacaaacggacagtttcaggtcgtaatcggccagggaactgtcaataaagtatatgctgaactggttaaggaaacggggattggcgagtcaacaaaggatgaagtgaagaaggcctcagaaaaaaatatgaatcctttgcagcgtgctgtgaaaacgcttgcagatatttttattccaatattgcctgcgattgtcacggcgggtcttttaatggggatcaataacattttaacggcggaaggcattttcttcagtacaaaatcgattgtgcaggtttatccgcagtgggcggatcttgctaatatgattaacctgattgcaggcacggcctttacgtttttgcctgcgttaatcggatggtctgccgtcaagcggttcggcggcaatccgcttctcggcattgtgctcggagttatgctcgtgcatcctgatttgctgaatgcgtggggatatggagcggcagaacaaagcggagagatcccggtatggaatctattcggcctagaggtgcagaaagtcggctatcagggccaggtgctcccaattttgcttgcttcttatatgctggcgaagattgaggtatttttaacaaaacgcacacctgagggcatacagctgctcgttgtcgcaccaattacgcttctcttaacaggatttgcctcttttatcattatcggcccgattacatttgcgatcggtaatgtactgacttcagggcttatctcggtgttcggttcttttgccgcactgggcggtctgttatatggcggtttctactcagcgctcgtgattaccggtatgcatcacacgtttcttgcagtcgacctgcagctcatcggatcaaagctcggcggcacctttttatggccgatgctggcgctttctaatatcgcacaaggttcggcggctctggccatgatgtttatcgtgaaggatgagaaacaaaaaggcctctccctcacatcagggatttctgcttatcttggcattacagagcctgccatctttggggtgaatctgcgatacagattcccgtttatcattgcaatggtcagctctggcctggccggaatgtatatttcttctcaaggtgtgctggcaagctccgtcggtgtcggcggcgtgccggggattttctcaatcatgagccagtactggggcgcgtttgcaatcgggatggctattgtattgatcgtgccgtttgccggaacatacgcgtatgcgagattcaaacataaataacaaatggggagcgggacgtgttgaacgttcccttttcccgttttcaatttaaatatggtggtggaaacagatgaaaacagaacaaacgccatggtggaaaaaagctgtggtttatcaaatttatccgaagagctttaacgatacgacgggaaacggtgtcggcgatttgaacggcattattgaaaagctggattacttaaaaacacttcaagtggatgtgctatggctgacgccgatttatgattctcctcagcatgataatgggtacgatattcgtgattgttactcgatttatcctgaatacggaacgatggaggattttgagcggctagtgtccgaagcacataaaagagacttgaaagtcgtcatggatcttgttgtcaatcatacgtcaacagagcacaaatggtttcgcgaggcgatctcttccatagacaacccgtatcgtgatttttatatatggaaagacccgcaggaaaacggttctcttccgacgaactgggaatcgaaattcggcggctcggcatgggagcttgatgaagcgtcgggccaatactatttgcatctgtttgacgtgacacaggctgatttgaattgggaaaatgaagaggtcagaaagcatgtctatgacatgatgcatttttggtttgaaaagggaatagacggcttcaggcttgatgtcatcaacctgatttctaaagatcagcgctttccgaatgcggaggatggcggcgacggccgctctttttacactgatgggccgcgggtgcacgaatttctgcatgaaatgaacgaaaaggtgttttcgcattacgacagcatgacggtcggtgagatgtcttcaacaaccgtagaccactgcatccggtatacgaatcctgacaataaagaacttgatatgacattcagcttccatcatctcaaggttgactatcccaacggcgaaaaatgggccttggcgccgtttgactttttgaagctgaaggagatcctatccgactggcaaacggggatgcacgcaggagggggatggaacgctctgttctggtgcaatcatgatcagccgcgcgttgtatcaagatatggagatgatggcgcatatagggtgaaatcggcgaaaatgcttgctacggccattcatatgatgcagggcacgccttatatttatcagggcgaggagctgggaatgacgaatccgaagttttcggacatcagctcctatcgggatgtcgaatcgctgaacatgtatcacgcctttaaggaaaaaggaatggcagatcaagagatcacagccattttacaggcgaaatcccgcgacaattccagaacgcctgtccaatgggatgatacgccgaatggcggttttacaacgggcaccccatggataccggtcgccggcaactatcgggaaatcaatgccgaagcggcgctgagggatcaaaattcggtgttttaccattatcaaaaattgattcagattcgcaaaatgtatgacattgtgacagagggaacgtatgagataatcgcaaagaatgacccgaacatttttgcgtatctcagacacggcagcaatgaaaagctgctcgtgatcaataatttttacgggacagaggcggcctttacactgccggactctttagcgcctgacgaatggaaggcagaggtgctgttgacgaacgatgaagcaagggaagggcttcagaacatgacgcttcgcccgtatgagtccattgtttatcgtttaacgaaaccgtgttaaactaagctgggtggtccataatgaaggtgaataaattcatcacaatttataaagacatcgcacagcaaattgaaggcggccgatggaaagcggaggagattcttccgtctgaacatgagttgaccgcacagtacggtacatcaagagaaacggtccgaaaggcgcttcatatgctcgcgcaaaacggttatatccagaaaatcaggggaaaaggctccgtcgtgctcaaccgtgaaaaaatgcagtttcccgtttcgggccttgtcagcttcaaggagctcgcgcaaacgcttggcaaagaaacgaaaacaactgtacacaaattcgggctggcgcctccgtcagagctgatccaaaaacagctccgggccaatctggatgacgacatctgggaagtcatcaggtctagaaagattgacggggaacatgtgattttggacaaggattactttttcagaaagcatgtccctcacctgacgaaagaaatttgtgaaaactccatatatgagtatatagaaggagagctcggtctttcgatcagttacgcccaaaaagaaattgtcgccgagccgtgtacggacgaggacagagagctgctcgatttacgcggctatgaccatatggtcgtggtgagaaactacgtctttttggaggataccagtttgtttcaatatacggaaagcagacaccgtctcgacaaattccgatttgttgattttgcgcggcgggggaaatgagagaggcgcctgcctgcggcagtgcgcttttttgtttggtatcaaaattgatactatccaacaaaaatgtgcgtacttttactttttatcataatggctacaatagagatgagagtaacctaaaggagaggtgttttacatggcagatctaaagaaacaaattctggatgcatacaatttcaggcatgcgactaaggaatttgacccgaataaaaaagtgtcagacagcgattttgaatttattttagaaacaggaagactgtctccgagctcactcggccttgagccttggaaatttgtcgtcgtccaaaatccggaattccgcgagaagcttcgtgaatacacatggggcgcgcaaaagcagctgccgaccgcaagccatttcgtcctgattcttgcgcgtacagcgaaggatatcaaatataatgcggactacatcaaacgtcatttaaaagaagtaaaacaaatgcctcaagacgtgtacgaaggctatttaagcaaaacagaagaattccagaaaaacgatttgcatttgcttgaaagtgacagaacattgtttgactgggcatcaaaacaaacctatatcgcgcttggcaacatgatgactgccgctgcgcaaatcggtgttgattcctgcccgatcgaaggcttccagtacgatcacatccaccgtattcttgaagaagaaggccttctggaaaacggaagctttgatatttctgtgatggtggcattcggctatcgagtgagagaccctcgcccgaaaacaagatctgctgttgaagatgttgtgaagtgggtttaaataaagaaagctgctcgctaagcgagcagctctttttttatgcctgattcgctctattctgttttctcctctgatgtaagtacattgccgttccgagtgcactaatcagaaatccggccaacaggatcgagtacatggatgtggctgtgtccggaagcaggccgccagccggaccgtctgttcctgatccgcccgaaccgtttccaccagagccgttagtcagttgagtgccgggaggcgtatcatttcctccgtttccgtcagttggctgttttccgcctggtttgtcggagcctccgccatgattgccgtcatcaccgcctgtcggttggtcggacgggaatgccggcggtttgttgtttgaaccggaatttaagatcgtgtattcgctgaagtggtttgtatatcctgtcaccatatcatcatcgactgatccgtgacctgtctttgtgaaagctttcttttttctatcgacgtgataaatggcagggttatgggcttcttcaatatcaaacatgcgaagcgaaagctgtacgggctccttgaatgattttatttcttttcctttttgcttcactgtaaagtcatatacatctgacagtgacacatccaattctcccgtagacttgattccgattgcagtgtctgcggttttaaggttcgccattggcatcttcatgctgtaccagtagttgaacatcgtcaatgaaggatctgactctctttctttcaaaagtttgacctgatcttttttcactttaagattgataggcttctcttgagatccttcatgtattccataatagacaaatggcgtgttggcatttttagcataaatcgcaaatttgtcttcatcaagtgtccagctgccgtccttctgctttgtcggcaggaatacttctttgatccgtccttcaactttaggagagaccttgtttcctagttttttcagctgttcggtgaaaatctcataatcaacgtagccaaggtcttcaccatgggaggcttctgtaaagacagaatatccgtctcctccggcaccgacaaaattatttgttgccacgcggtaggtatcatccgtatttatagcaactttgtctccgttaggcgattcaattttcacttctaatacacggtgtccaggttcgttgtttaatgtaaaggtatattcgattccggccacctgagggaaagcgccgccgccattttccacattgcttaggccttgttcaagggcttctttaatttgttttccggttaaatcggccacgtaaagcgtattgccgaacggcatcacgttgagcacctcgccgagtgtgatatcacctttgtcaatgcctgctctgatgccgccgccatttgttatcgctattctggcgccggctgcttctttcgcttttgccagcataccgtccgcgatgaagtttccgagattcgtttctttcgtgcgcacatgctcacgctggccgtcaagcgccacatccgtatagccgactttttcatttttcacgtcttctaattcacttttgaactgatcaagctcttgttttgcttctgcgttttcttctgtatgctcatcaattggcagcacgctcagatttgatttgtctgtttgcacaacgccattttcatcaaacgcgacatcaacgcgccccaagaattggccgtattcttttgcctgcgccacgatcgtcggttcttcgttgtttacgacctccattttgtcaacgagggtgtgagtgtgtccgccgatgatcaagtcaatgccttttacttttttggctagctcaagatcacggttatgaccgatatgtgttaaagcaataattttatttaccttttcttcttcctgaatcgctttgacggtgttttgtgctgtttcaaaggcatcattgaatacgatgcttttgcccgggcttgatgtggtggctgtatcttctgttgtcaggccgaatacggcgactttctccccgtcaacgtctaacagaatgtaagggtgaatgccggcctctttcttttcacctgccgtaaaggtttgcggctttttgacaaatgatttcagcttgggctcatttgacacatctacgtttgcactgacaatcggaaattccggcgcttcaaagtgatagcggttcgccggatcaacggttgcgctgtttccgcttagaaaatcagaaagcactgtcgggcctttgtcaaattcatgatttccgaaggtcatggcgtcatagcccatcatgttcatcattttcagatcggccaaaccgttccattttgtaaaatacagatcgccggaaaacacatctcccgcatcaaggagaatgttgtgatttgtttcgctgcgtacttcgttgattttcgtcattcgtcttgctgcatcatcgagatgtgcgtgcgtatcattggtgtgcatgacggtcaggtcccacagtccgtctttaggaggatctggatttgaatcatcatcgaattgcagcttatacacaccatagccttcattcgcagacttgcctacataagcgacgtcgtctgctttatcggcaaatggcttggccaaaagcgaggattcaaacgtcagattcgtgccggaaacaggcgcgattgaccagttgttgtctgcttttggattgactgttttttgttcaataatgtaatccatcagcacctgcctattttcaactgcagagccgtggacaattttatcgctcgtcagatgagggaacccgccgcctccggacgcacgatagttattggtgactacgagaaattcctggcttgggctgatcggcttgccttcataggaaagattgatgatacgggatgaatccgcattgatcacttttccgttctcattgtatttagccggttttgtcacatcgacctgatatgtgacaccgtcaatcacatcaaaattataggagcggaaattctcgttcagtaaggcctgatcgccgcctttggctggatcaatttgattgaattggcctgctgacatctccagccagtccttcacttcgctgcctgtcagcttgacgatttgaacagtattatcgtaaaggtacaagtcaccgacatttttaatcgcaagatctccggctggaatgtttgtatagtaattggctccgtttctgccgcctgctttaaacggcgctccagcggataaaatcggcaggttcttgtactcggtatccttcatttctttttcagcgtaccacttttgcgcgtcagtcacgatctgaatggaaggatcatctttgacctgtgcaaagaagctgttaatatctgcttcggttttgccgactggctttcggacatactccagtgtgttttggtgtgtttgctgaatggtgtttgtaacggtttcgtttcttgatgtgacgttgccagcaatagattcaatacttcctttggaatctgctaccttccatgagccgtccgccttttcaagcttgaggtcaatcacgcctaaatatttgccccagctgcttggcatgacgacaggaatgccgttaattgttcccttttccacattgaactgagcaacacccgcatactcggcggaaggaaagagtccgtgctgatggcccgagataatcgcgtcaatgcctttcgttttggtggcaaggtcaaatacggcgttttctgcacctgatgattgtgactgcttttcaatgccggtgtgggcgagggcaataatgacatctgcgccttccgccttcattttcgggattgtttcattggcggattctacgatatcctgcacctgaacctgcccctcgagattctttttgtcccatgtcatgatttgcggcgggacaaagcctatgtaaccgacttttactttctgctcattaccgttttcatcaatgagggttttttcattaatcacatacggcgtataacggttttcgccgctagttgttttgacgttggcatttacaatcgggaaatcggctcctttgattgtgccgtcgagaaagtcgagcccgtagttgaattcatgattgccaagcgttccggcgtcgtatttcagcgcattcatgacgctgataatcggatgggttttcgtgccggagataatgtcgtctttttgatatttcaccgcgtattcacccagcggattcccttgaatcaagtcgccgttatccacaagcagggtgttagggttttgctcgcggtgcttttggatcaattgcgctgttctcgccagaccgaaatccgccgtttctttgtcactgtagtaatcgtaatccatcatgttggcatgaatatcagtcgtagccaaaatactcagatgcacctgaggagccgcgctttcttctgcatgaatgggtggtgttgggaggattaggctaagtatcataattgggggcaaaagaatacggagaatgttttcgacgtgtgttcgtcttttctgtattctcaccagttctccacctttcaacgaaatttgtgttacagctcctattgtaagaatattttgtaactatttgtaggtgtttctttatgattattgtaaaagggagaaaaatgagtattatgtagcagtatcaagcgacaaatactgggtatttatgcttatcgtttgtcacaatcgcggaatgtttattttagtgtggctggggtagagtgttttatgtagacatataaagcgggaggttatgaatcatggggaaaaaaattgcagtggttttaacagattattttgaggacagcgagtacactgagcctgcgaaagcctttaaagaagcgggacatgaactgactgtcatcgaaaaagaaaaaggaaaaacagtaaaaggcaagcagggaaaagcggaagtgacggttgacgcgtccattgacgacgtaaacccttcagactttgatgcgcttttgattcccggaggattttcaccagaccagcttcgcgctgacgatcgtttcgtccaatttacaaaagcgtttatgactgacaaaaaaccggtattcgccatttgccacggcccgcagcttttaatcaatgcgaaagcgctcgacggccgaaaagcgacgggctatacgtccattcgtgttgacatggaaaacgccggtgccgacgttgtggacaaggaagtggttgtttgccaggatcaattggtcactagccgcacaccggacgatataccggcatttaaccgcgagtcattggcattgcttgagaaataagaaaaaacggacgctcttgggcgtccgtttttttgttgcttaggcttgagcacctgtcagtttcttgtacctgtaatacaagaaagcagctgcagccgttccgatgaccgcaatgccgaagtcgaatatgaaaatatgggcgatgccccccgcttttgcgataagccctgttgcaatcggcagcagaatcgatgcaaggcttgaagcggtcgctacaattccggtaacggttccttttcgcttccagaaaagctctgtcattaacgtaatggtaatttgaaacacacccgcagttgaaaagcctaagaaaaaggcagtgatgtccagcacaactgggatatgaacggtcagcatgactgcgagcgtacataaagtaataataggatataagagcgttatgaagacaggtttgacccatctattcagcaaaacggctaataataaaacagatgccagagatcctatactataatagctcagcaattgtacagatgctgattcagctaaaccggctgccttttgcgcgtagctcgggagccagatttgagaaaccgtaaataaagccgtggatgtaaaaccgatgataatcagtgcggtgccttccttctgaaaaacgggttcagacaagaaaacgggagattcctgttggccgctattagttggtttcttatgttttttaggaaacgaaagcgttgataaataaataatattcaggagatagaccgctgccggcagataaaaagcaaatccgtaaaacatgctgtggtctgctaaaaatgtgatcaaaagcggcaaaagtgcggccccgacagacataaaggctttgaccaagacattcgccgaaccggaagcagacggaaagagctcggttagggccggatatgttccggcatccatggctgaattagcgactccggctaataaagcgaacacaaacgccagttcatagctcggtgataaaggaataccgactaaaaagacggccataattcccgcagaagcgacaacaagcggctttctgccgattttatctgatagaactccggaaatgccgtatgtcagcagtttgccaaacccgatagcggcaatgacataactgatgccggtcggatcggtattccactgttttgttaatgaggacatattggatgcgagaataatgttgaccatccccagaaagaagtagttgatatacattccggatgctgttttgatagatgtcgtttgcatgcttgtactccttcagatcttattcgaacactttactgttttggtttgaggaaatgataaaaaagactcgccgagtttccggccagtctccattatttacgaagcgaggctaattcttgagcaattgcctgcatttcacttgggctgaatgattcttttttcatcaccatgctgtgaaggtacgtgaggtcttcaatcttctcatcactgaaatcctccgctttgattacgccgacgttcagcatgttcagcttttgggaaatctcttcaatcatttgagttaatgtttctgtatttgggctggacaaatggttccatcctttctatgcgcaatataggtatgttttattctaacagaattccatcagaaaaaaaccctattctaaaagcaggcttttaattccaaaaaagtgaagacatcagttgaaaaggaaatgaacatcctactaagatattcatgaaggtttctttttagagaaataggggcaaagaatagggaggttgcacatcatgataagcgtgttatttgtttgtttaggtaacatttgccggtctccgatggcggaagcgatttttcgggacctggcagccaaaaaaggattagaggggaaaatcaaggcggactcagccggtattggcggctggcacatcggcaaccccccgcatgagggaacgcaggagatattgcgcagagaaggaatcagctttgatggcatgctggcgcgtcaagtcagcgaacaggatctggacgattttgattacatcattgcgatggacgcagaaaatatcgggagcctcagaagcatggcgggttttaaaaacacctcgcatatcaaaaggctcttggactatgttgaagattcagatctggctgacgtacccgatccttactacacagggaactttgaagaggtctgccaattaatcaaaacgggctgtgagcagttgcttgcatccattcaaaaagaaaaacaattgtgagtgaaaggagaatttgcatgaacaacgaacgtttaatgctgaaagggatatttctcggagctgcggcaggcgcggcgttatcactgctccataagccgacaagacaggcgtgcgggatgagatggctgacatgcaagcataaactttcactgtacaaaagcaacccagagctgttaaaaaacactgtcatcacaaaagtggatgaggccaaaaagctcgcccgaacgctttcaaaggaagtcgactttgtgaaccagcaggtgaaagagctgaagaaaacaacgccgcaagtgatggaactcgtgcaagaaacgaaagagcatttttcaaaaaaatgatcaaacatgcgaggtgagacgacatgagttttttgaaagagcttttcagcagatacacccttcatgaaggacaaagtaaatcagcggagctggcgtatttttttctattgtcactgtttccgtttttgatttttatgctgacgctcaccgcgtatcttccgctttctaccgatgatgttttaggagtcatagaacaatatgctcccgccagtgcgatgtcactcgttgaatccattacccatcaaaccttaaataatcgaaatggcggtttgctgtcattcgggattatcgccgcattatggtctgcgtctaatggaatgaacgcgatcgtccggtcgctgaaccacgcgtatgatgtggaagaaaaccgctcttttatcattgttcgtctaacctctatttttttgacgattgccatggtatttacgattttagtggctttgcttctgccggtatttggcagggagattggaaggctcgcttctgactttgtcggcgcatcggatctgtttttatccgtctgggccgccattcgctggggtgtcagcccgcttgtgcttttgattgttttttccgcgctgtatgtgattgcgccgaacaaaaagctgtctctccggtttgtcatgccgggtgcggtctttgcgaccatcggctggattattgtcagcacactgttttcgttttacgtcagcacgtttgcgaactatagcgccacttacgggagcatcgggggaatcatcgttctgatgatttggttttacttgagcggcattttaattatcctaggcggagaaatcaacgctcttttacataaacgtaaaaagcttcctgatgaaaatccctaccattagcgcaccctataaacgaacttcggttcaaaaagaagtcgggggatatcgtgatgaccaagcatacgaaaaaaggcggaagccataacaaacaaaattcgaaaagcaaatcgagcaataaaacaagcggaagcgccaacggacaaaacggctaccattagcataaaagcctcctgacatgatgtcgggaggctttttgattaagaagatgaagaataggtttcagccggtgaccagcttttcggtttgcccagcacaagggccagccacacagcgctaagcgtgagagtaatgaagtagaacaagtttgcgctttcaaatgtctgcatataccagccgccggcaaccgggccgaggatgctgccgagactgaatgtaatgccgcaaagcaggtttcccgccggcaggaggtgaggcgggagaagatctgtcatatagctgatgccaagtgtaaaggttgatccgactgccattcctgcaataaaaaagcagccgccgatcacgtaaggcgaaggaaatacaccggcgatgaaaaagcaaagagccccagtcagcaaaatcaccagcagcacattccgcctgccgtatctatcgctgaggatgccgagcggaaactgaaaaataatgcttccaatcgcaaatgcgggaaggatgatcgctactgcgtctactgatatccccaaacggagcgcgtacaccggaaagcttccgttcagcgccgtttccaaaaagccatagccaaatgtaggcataaaggcaacccacccaaacagcatggcctgataaaatcgcctgaaactattgtctgatttggtttcatgaggactggtttccgggtatgcattttgtagaaagaaaacaaaaagccacgcaaacagactgatgcagccggacacgataaaaggaagcgacggactcagcttgacaagcggcaccatgaacgggcctgcggcaaagccaaggccaaaggaaagcccgtaaatagacaggtttcttccgcgattttgttttgatgacatggaggtcacccacgtttgcgtagaaaagtgaagcatgtggtcgccgattccaatgaacaggcgaagcaggaaccagacccaaactgactgaagccaaataaatccgaataagcttaaaatgacaatgcttccgcccatgacgatcagcggcttgaacccgagctttctgagcggtgcttccataaacggcgaagccaaaagcacaccgatatacagcccggtcgcgtgcaggccgttgatagcagcggattctccatttgtttcaaaaatgattgaaatgacaggcagcagcatgccttgtgaaaacccggaaatggaaacgagcaagacaaggataaagaaatgaaatcgtgacatcgtgtcagttctccttatgtggaatctatgttgatcgtacaatgttttccaaaagcaggcaacctgaaaaaagcctatatcacgctatacatttgccctcgtgtaatcatgaaggtttttgtgaagaataaaaataaaacaagtcataaaaaaggagctatttcaccatgaatcgtatcttttttattttagtggcggccggtgttccgctttctgtgattggcagtttgatgcattggccttccgcggttctatttgccgtttattgcgtgacgattatcgcgcttgcaagctatatggggagggcgacagaatcactgtccattattgcaggaccgcgtatcggcggtttgttgaatgccaccttcgggaatgcggtggagctgattatttccctttttgcattaaaagaaggcctgacaggaatcgtgcttgcctctttaaccggttcagtgctggggaacctgctgctggtagcgggcctatcgttttttgtcggcggtttaaaatataagcggcaggaatttaatatccatgatgcccgccataattccgggcttctgatttttgccatcattgtcgcctttgtgattccggaggtattctctgttggtatgggaaacgccagcaagctcaatttaagcatcggcatcagcatcattatgattctgttatatgtcgcggcgctgtactttaaacttgtcacgcatcggggcgtttatcagccgaataatgcggctcagactgaagaagaggaagagccggaatggtcagggaaggttgcgacgattgtcttgtttgcggcaacgattgtggttgcatacatatccgaaaacctggtccatacctttcactcggtggctgaacagttcggctggagcgagctgtttatcggggtcatcatcgtggcgattgtaggaaatgcggcggagcacgcgtcagcgattattatggccttcaaaaataaaatggacattgcggttgaaattgcagtcggctctacgctgcagatcgctatgtttgttgcaccggttctcgtcatctgttctatcttttttccgacaagcatgccgcttgtatttacattgccggagctcgtcgcgatggtatcagcggttctcttgatgatcgcgatttcgaatgacggggattccaactggtttgaaggggcgacactgcttgctgcatatgtcattatggcgatcggctttttccttctttaacctgaaaaaatgatggataacaacaaagcgggatgaaaagactaagggaaaatgccatagaaagagtgatatgatgaaaaagctatttcattccacacttattgtgttgttattctttagttttttcggcgttcagcccatccacgcgaaaaagcagtttaaggttcctaattctgtcgcaagcatttcaaaggaaaacacgtatccgaatgcttcacaggatcagccaatgcttcagccgagcaagctggcaaaggaattgctcgatcattctgaggtaaagattgaaaatccgcatctcatcaaaatgctgaatgaatccaacatatccggcacaccgcttgcagtagggtaccgggcgacaatatttctcgggaaatgggcgctcggctatgaatcaaatgaaacagtcgcaaactgggaatataaaaaaatcaatacaaaccgtgcggataaccgcggcgggaaagaaactgctgaaatgcattatgcccaggaacagcagtacagagtgaagggcggcttgacagctaaagttccaaatgctgaagatgtcaaaagcatgatgatgcaaaaagcaatgaagaaaacgaaccttccgcttgcatttgagacggtcatcggggctggcacaaaacgggatcagatttataaagtcgctcctaaaaaaatcggttatctacatgcatatgcaccggctgtgaatgaaaaaggaaaagtgacttacggagaagtgtacttagtgctgaaaggaaataaacgaaaactcgtcgtgaaaaatgtcacgtcacagggaatcggcgcctggattccggttcaagatcatgtcacatttggctttcagctttcctcactgccaagataaataaaaaactgattccaactcggaatcagtttttttgtttattgggttctctcaattcggaccgcttcctcaagcatttgcacattgttttggtagagctggcgaacgagaacccgtcttactgcaaggctggcactgaaataatcatcatctttcaccatgcctttaaccgtaaattcgacgccgcgattgattttattcaatgcggtgatgccgtggatttgaaacggttctgtcggattgccgaattcatcccgcttcaatgaatcacgaagctcttcattcagcatgtcacatgcctcttccaacacgctgtacacgcggtccggatcttctttaaagctgataagaaaggattcggtaatccgcataaaatcaatattatagttctctatttgtctgacctcgccgttgctgatggtgagcagcttcccgctccattcccggatttgcagcgagcggaggccgatttcctccactgtcccgttgaacaagttgttgacggtgacataatcgcctttgtgcagctggcgttcatatattaagaacacaccagccagcacatctttgatcagcgattgggcgccaaaaccgatcacgatacctgctacgcccgccccggccaatatcttgccgaaatcatgcacaaataaagaaataacgtaaaagataaaaccaattgtcgccgtatactgggtgacagaacggacaaggctttcaatcgttttttcctttttttcttcaataaaatccgtccgtttaaaaaatagctgtaccagccggttgatgataaagacaccgatccaaaggataacggcaacgaggagaatatcgacgattttattttgaaaaatctccgtaagtgtttctttcatccgcatctaactcctggcttgacgttttgtgaagtctgtatcctgataataactgtttttgacaagaacattcggtccgaggcaccggacattcgggcagtggcaacttagttccttcgcaagcttggtctctctccacttttcataggcggaagggaggctgtccgtctgaatgttgccaagcggcggggtatcaccgaaatcggtcacgataatgtttccgtcgaaaatgttcacattcaggcgggatcggccgtcagggtcatttcgcactgtgacgtttttcgccgcgcgaagccggcgaagcagcttttggtcgtcttcgtccggactgcaggcataaaacggcagcgttccgaacagcatccacgtattttcatcacgaatatccagcaagcggtgaatggcctgtctcatctctttcaggctgagggattcaagagcgcttgcgaaatcgcttggatacattgggtggacctcgtgacgctgacatttcatatcttctgtgatttggcggtgaatatgctcaatatgcggaagtgttcgtttgttcagcatcgtttccgcagataccattactccggcatccacgagcgtgcggctgttttcgatcattttttcaaaatagcgcgcgcgctgttcgaaggtcggttttctgtccatcatggcaaagccgatttcagcaaaatcttcaactgtaccccagttatgagaaatatgtagcacatcgagatacggaatgatccattcgtaccgctcgatgtcgagggtcagatttgaattaatttgtgtccgcacaccccgttcatgggcatatttcaataaaggaacaacatattcttttactgatttcaacgaaagcatcggctctccgcctgtgatgctgatggatctgaggcgcgggatttcctccagccgttttaacagaagatctattggcagagcattcgggtctttaggctgcaatgtatagcctacagcacaatgctcgcatctcatattgcacagtgtcgtcgttgtgaattcaacgtttgtcagctgcatgtctccgtattggtcaacatccatataggcttcccaagggtcaaactcgggcgtaatcggacgcagcttcgtgttttgtgtcatgactatctaactcctttataaatgggcatactaacgctgccaacagttaattttagacctgatttgccaagatcgcaagtagcgcggcgattgaaaaacggcaaaaaatgagctaccataataaaaaatgaatggaggaacagaatggggaacgccgtaaacaataaagatcagcagattgattatttaaagaacagacttgacatgtttatgaacgtcatcgattcattagaccctgaagcaaccgacgttgaagatatagacaggctcatcagcatgcttgatgacctggaagccaaatacgaacgttttaaaaaagattgggaataaaaccgcgcgcccgctgcggtttttttattggcataaagcaacagtataaaacaaagcccctatctgtaaaataagaaaaaatgcagaaggagcgctggccatgaagtggatgtgttcaatatgctgcgccgccgtattgcttgccggaggtgcagcacaggcggaagcggtgccgaatgagccgattaattggggctttaaacgaagtgtcaatcatcagccgccagatgccgggaagcagctgaacagtttaattgaaaaatatgacgcgttttatttagggaatacaaaggaaaaaacgatttacttaacgtttgataacggatatgaaaatggctatacgccaaaagtgcttgatgtcttaaaaaaacatcgcgtaacaggaacgttttttgtcaccgggcatttcgtaaaggaccagcctcagctgatcaaacgaatgtcagatgagggccatattatcggcaaccattcctttcaccatccggatttaacgacaaaaacagctgatcagattcaggatgaacttgattcagtcaacgaagaggtttataaaattacgggaaagcaggacaacctgtacttgcgtccgccgcgcggcgtgttcagtgagtacgtactgaaagaaacgaaacgcctcggctatcaaaccgttttctggtcggtcgcttttgttgattggaaaatcaacaaccaaaaggggaagaaatatgcctacgatcatatgatcaagcaggcgcacccgggagccatttacctgctgcacaccgtatcaagggacaatgcagaagcgctggatgacgcgattacagatctgaaaaaacagggctacacatttaaaagcattgatgatctgatgtttgagaaagaaatgaagatgccgtccttgtaatgagaagagcctctcctgaaatggagaggcttttctttattttatacatttaatcagtgtggcccaatccagatctccgaagccctgttcaatcccgctttcaaaatggctcttggccagctcggcaagaggaagatttgcagaaacccgttttgcggcggcgagtgccaggttggtatccttcagccctaaagacattttgaagccggccggctcaaatttctgctcggccataatggttccgtaattttgatagactggagaaccaaagagcgcgctggcgatctctaaaaattgtttttgttctaagccgtatttctccatcattaaaaaggattcagataacgcctccagcatggacacaagcaagaaattgatgctgattttggctgcatttgccgtcttgctttcttcgccgacgtcaaatacctgctggctcaggctgtcgaacagaggcttggcagcttgctttgcttccgccggtccggctgttatgatacggagcgcggctttggctgcggcatccggtctgccaaggacaggagcggcgagaaaaaattgtcctttctctgcatgagccgctgcgagcttttctgagaactcaacactgattgtgctcatcgagatgtgaatgccgttctctgctaatccttcaagcagcccgtcttctccgaatgtcacggtgctgactgaatcatcatctgcaagcattgtgatgacaatatcagcggattttgccgccagccgtggcgtatcagctgcctgtgcgccttctgtgacaaggtcttctgtcttttgtttcgtccggttatagacagtcaattcgtagcctgcttgaagaacatttcgggcaatgggctgtcccatattgccgagtccgatgacagcaattttcaatctaatcactccctgaatattttttccattataaacaatatgaacagaatatgcatagcgatcggcttacaacaaaaaagaacagctgctcgctgtcctcatttaaaaatattgaaccatcctttatgtacaaaccaaatcagcattccaatcacaagcgcggccatcaggccaagtacagcgaaatatccgtatttccaatgcagctccggcataaagtcgaagttcataccgtatacaccggcaataaaggtgagcgggatgaaaatggttgatacgatcgtcagtgtcatcataatcgcattcatccggtttgagtttagcgtcacgtagctgtcacgcaagtcggacgtcatgtcacggttggattccacaatttcagacaactttaacaaatgatcatatatgtcgctgaaataggctttcgtttcccgctgctctttcacatggtcaaggcttaaaatccgatagagcaaatcacgcatcgggataatcgtccgtctcaaatgcaataggtctgttctgagatcaaacacctcattcatcagcgttccatacgttttgtggggacggctttcttcaatttcattcagccggtcttcgattttatacacgagaggaaaatattcatcaacaagctgatccatgatcatataagaaatatgcccgggcccttttttcaatatgtccggtgaagcatacaaacgctcccggactttagcgataccgggcgtttcgtgtaaatgaaaggtgacgacaaatttttcgccttgaaagatatcgacttcctccgtctcaagtgtttccttattcagcgcatgaatcacgtaaaaacgatagccgtcataatggtcaagcttcggccgctgcatatgctggaagcaatcctcaatggcaagcgggtgaaaatgaaaaaaatctctcaataacgccgtttccgtatcctccgggccgtaaaaatcaacccagtaccatgcaatatcaggctgttccactcgttcgatcggtatatttttcagcagctgatgctctgttgtgattgcggtaatgttgatcataaacaaccctccacctgccattatatcatgcggtctttatgagaaaagtatacggtactctctgcctaattcaagcggcatgttatactgaacaaaaacggaaaaagggtggatctcatgtggaaggaaaaagtatctgtcacgcctccgtatcattttgaccgcgtgctggacaggctgtctttagaccccctcaattctgttgatcgagaggcgagggaagtccgtgtgccaatcagaaatcaagcgggggacgtatgtattgtaaaggtacaggcgttaggccatgcgggtgagcctgagttcctcgtcagcggggaaacggatcagggagaaatgatgaaggaaatcaagcggatttttcaatgggaaaatcatttgcagcacgttctggatcatttttcaaaaacgagcctgtccgccatttttgaagagcatgcagggaccccgcttgttctggactacagcgtgtacaactgcatgatgaaatgcattatccaccagcagctcaatctttccttcgcttacacgctaacagaacggtttgttcatgcgtttggcgagcagaaggatggcgtgtggtgctacccaaagccggaaacgattgcagaactcgattatcaggatctgcgtgatctgcaattcagcatgagaaaagcggaatacaccattgatacatcaaggatgatcgcagaaggcacactcagcttgtcagagctgccgcatatggcggatgaagacattatgaagaaactgatcaaaatcaggggtatcggcccgtggaccgtgcaaaacgtcctcatgttcggacttggccgtcccaatttattcccgcttgccgatatcggcctccagaatgccatcaaacgccattttcagctggacgataagccggcaaaggatgtcatgctggcgatgagcaaggagtgggagccttatttaagctatgcgtctttgtatttgtggagaagtatagaataattcgtctgacaatgaaggaaatcctgcaaacgtgttatactagaaagatgtgaaaaaaccatttcactttctgccatctgcagaaagctttatatagaaacggagagaacaacgtgaaccaacaaaagaaacaggcgcctgtcgaactgaaggtcggacaaacctttccgctgacgattaagcgtctcggcattaacggagaaggtgtcggctattttaagaaaaaagtcgtcttcgtgcccggcgcgcttcctggcgaagaagttgttgtgcaggccacaaaggtccagccgaagttttcggagggccgcattaagaaaatccgcaaggcgtctgagcaccgggtagcaccgccttgccctgtttatgagcaatgcggcggctgtcagcttcagcaccttgcatacagccagcagcttcgggaaaaacgcgatatcgtcattcagtctcttgaacgccatacgaagtttaaagttgaaaacatggaaatcaaagaaacgatcggcatggacaacccgtggaattaccgcaataaaagccaattccagatcgggcgctcgcaaagcggcagcatcatcgccggcttatacggccttgattctcatgatatcgtgccgattaaagactgtatcgttcagcatccggcaacgaacaaaacaacaggcatcgtccgccgcattttagaggacttcaatgtgtctgtttataatgaaagaaaacgaaaaggcgacgttcgcacgatcgtgacgagagtcggctttgaaacaggcgaagtgcaggtcgtgcttgtaaccgcaaaagaaacgcttccgcacaaggaagaaatcgtcaaagcgattcaaaagcgattgccagaggtcaaatccattattcagaatgtaaacggggcgaaaacctcagtgatttttggtgagaaaacaaaacagctcgccggaaaaacagtgattcaagaagtgctcggcgacgtatcttttgaattgagcgcccgcgctttcttccagctcaatccggaacagaccgtcaagctgtatgatgaagtgaaaaaagcggcgcagctgaccggaaaagaaaaagtcgttgatgcgtattgcggcgtcggcactatcggcatgtgggttgcggacggagcgaaggaagtccgcggcatggacgtcatcaaggaatcaattgacgatgctaagaaaaacgccaaaaaatacggcatggcaaatgccacatacgtaacaggaacagccgagcactggctcccgaaatggacgaaagaaggcttccgcccggacgtcgtcattgtagacccgccaagaaccggctgtgacagcacgttcttggacacgatcaaaaaagtcaaaccgaaacgctttgtctacgtttcctgcaatccatccacgctcgcgaaggatttgcagacgctgtcgaaggactatcgcgtggactatattcagcctgtcgatatgtttccgcagacggcgcatgttgaagcagtggcgagacttgtattgaaatcgtctaactaaaataaacaatactaatcagacctggatttcggtaaaataaacaattccgatttccgggtctttttcgtgcgcagcccttgtcctgactgtctttcccaaattttatcttccttcttttctcggagatctttattttaactggcgaaaagaattgaacaaacgtgttgaaaagcgggtgaaaaaagcgttatttaaccggaaaaatttccttccagtatgattaaaatacatgagtaaaatgatgtaaaatcatagatatatttttcataatttgtaaaattatatattaacttgcagttattacgtgtgaaatattgatgataggaatataaggaaaggtatggcgtatatcatttcaagagtcattcgatgtaaaaagttgaaacattgtaataaatgaaagaggtgaaaatgatggccaaccccattttaaaatgcataacgtatgagcactacaacaattaaataatagtgccgagacgataacaactattacagtaatacctacaatggttatatccttgagacaattatgcttcataatataaattttagattgacacttggctaaaaagtattgcagagaaggaaatggataactaaatggataaagtatataaaaaacgaccgttatataaaagaagttggtttcaaacatttttggcatttttagtatctcagctttattttaattttgtagaattaacgggatggggtcctaagtatagagaaatgaatggattcccagcaaacataggtgaactagatttctttcaaacatatctttcattctatgataatccatggtttaatattattactgttttcttgggagttttcactattatacaaataattacagggataacaaaggatattcgaaattaaagcaataacttctgatgccttatttaatgatgaaagaaaatgaacactttcttaattatcttatgagtgaagactgcgacacttagtcagcagtctattttattggttctggatcaggattaccgaattataactctatagtaggttgccacttgctgcgttggttattttctaaatcatgagcaaatcccaaacgatccagattgaagttcttgaattctttaaaataagggtttattttctcttctcatcctctttactccatgtgattcataagtggtagcagtagcttaagtaggttttttcattctcttgagtactagttataccacccccaactcaatttgcttaatcaaagtttatctcttgaaattagtttttccgcaaatatgatatagagatacggatatggtgtagtgttaaatatcttatcttcaataacagggcaattattttgcgttggtaatatggagaactcatatgatattctatttaggttggaatcctttttatccaaaaagttcaaaagcaaggccactaagaaagacgaaggtcagcgccagtgttaaccacaatataaaaaataggtatagatggtcatcccacgtgaaatgttcaaaaattactatagattgataagaaatgctttcgcatgcgataagtgtaaaaagaaagcatggtcagttttttaatattgagatacaggtatagccgtatcccctaatgaaaggatttgattttgttatgacagaaaatttctggcgtgaattaccacggccattttttgtactggcaccaatggaagatgtgacagatgttgttttccggcatgtagtaagtgaagcaggcagaccggatgtattttttacagagttcacaaactcagagagctattgccatccggatgggaaggatagcgtacgcggccgtttaacttttacagaggatgaacagccaatggtagcccatatatggggagataagcctgaaaacttccgtaaaatgagtattggcatggcagagttaggatttaaaggactagatatcaatatgggctgcccagtgcctaatgttgcggggaatggaaagggaagcggccttatttgccgtcctgcagttgcggcagaattaatacaagctgcaaaagcagggggattgcctgtaagcgtgaagacaagacttggatacacggatgtggatgaatggcgcgagtggctgacacacattttgaaacaggatattgccaatctttctattcatctgcgtactagggcagaaatgagcaaagtagatgcgcattgggagctcatcccggagattaagaaacttcgtgatgaggtggcaccagatacacttttgacgatcaatggtgatatccctgaccgccaaactggcttaaaacttgctgaacaatacggtgttgatgggattatgattgggcgtggtatttttacaaatccatttgcctttgaaaaggagccgaaagagcatagcagcaaggaattgcttgatctcttaaggctgcatctggatcttcatgataaatattcagcattagaagcccgtccgtacaagcctcttcctcgttttttcaaaatttatctccgcgggttccgaggggcaagtgaattaagaaatcaatgcatgaacacaaagtcaacagatgaagtgcgtgcattgctcgacgactttgagagaaagtatcttgatggggtagaataacagcagtgcttgattcaaaaaaggctaacaaaataaagggatttttacaccattcttgactaaaataaacctggattttcggtaaatccgggtcttttttgtacgcagcttttactcagcctgtcttttctctaatgtattgtaagaaaataatggtatatttagtggagatatcttataaagggggagaggaaaatgaaacgactatgcatcatcccctgcggcaagaaaaaaatctgggacgtccagcctgatgccgggccggtaagagcagaggacgcttatctcagcccgtttcatcaggcgtgcgaacggtatgcgaaagcatttttcgatgagtgggtgattttgtctgcgaagcacgggttcctccgccctgatgatctcgtttcgggaaattacgatgtcacttttggcaccggtcatccggaaatcatgacagcggacgagctgagccgccaatttcacgaaaaaggcttttctgatatcgaagagctagtcatgcttggcggaaaaaaatatcgaagcgttctaaacgccgtcatcggagaacaccagcatatcagctggccgctatcatcttacaaaggcataggctatatgctccaagcgctgaaccgggctgttgaagaaaagcatgaactgtagcacgtacatatgaggaaaagagtgggaacatgaaaaaacttgtgtttggcttgcttgccattgcattattcggatgcggactatatatctatcatgtatggttcggtgatccattttcgaaaaatgctgcagaacagaagctagtctcttatgtgaaacaaacctatcctaagaaagaaatcaagatcacgaatggggtatataacgctaaaacctctgaatatgtattcgaagcaacctcccaatctcatcgctacccaatgtgtacgaagggatttctgcatcataaagtaacgtgcgatggaattgaagaagcgtataccgaatcagtagcaaaacatgtaaatgaagaagcatcgaaggcaatcgaagcagatctgaaaaaaacggttcctcgacttataaaagctgatgctgctttgagtatcgaaaacggacagttcacgttagatacaaaatggaacaaacagctggctgaaaaagcgcctatgagtatgacgattcagttagacaccagcgggttatcaaaaacagatgccgcaaagatggcggaaacggtcagaaaaacgcttaatgaaaagggatacacatactcaaacggcacgatagactgtatgcagaaggacggggacggcggtatcggatatgtcaaatattcaattgattttctttcaaaagcagctattcagtcaaacgatgcagaggaactaggaagttaaaaagatttccaaggaaataaatacgtcgatcattgtcaaaggccgggtgatatccggtcttttttgcatgctgtaaaacgagacaaatgaatcagtttgagacaaaacgagacacacgtctcaaactgtctccaaggtgaagacgagaagactgattttacgggctcaaaagactggcacacttcttgcatttttaatggtgaaccctaaatagaaggaggcgcacaaaatggaattgttaaaacgagagggcttgtcattaactgaggaaaaagcgctgtggatgtaccaaaagatgctggagatcaggggctttgaagacaaagtgcatgaactgttcgcccagggagtgcttcccggattcgttcatttatatgccggtgaggaagccgtggctgtaggggtgtgcgctcatttacatgatggcgacagcattacaagcacacacaggggacatggacattgtatcgccaaaggctgcgatctggatggtatgatggcggaaattttcgggaaagcgaccggattgtgcaaaggcaagggcggttctatgcacattgcggatcttgataaaggcatgttaggcgcaaatggaatcgtcgggggcggctttacgctcgcatgcggatcagcgctcacggctaaatataaacagactaaaaatgtaagcgtttgctttttcggggacggggcaaataaccaaggcaccttccacgaagggctgaatttagcggctgtatggaaccttcctgtcgtatttgttgctgaaaacaacggctatggcgaagctaccccatttgagtatgcatcagcctgtgattcaatcgccgatcgggcggctgcttataacatgccgggggtgacagttgacggcaaagatattttagcagtttaccaggcagcgaaggaagcgatagaaagagcaagaaacggcggcggcccgtctttgattgaatgtatgacctacagaaactacggccatttcgaaggagatgcccaaacctataaaacgaaggatgaaagagttgagcaccttgaagaaaaagatgccattcaaggttttaaaaactaccttttaaaagaaacagatgctaataagctgtcagacattgaacagcgtgtcagcgaatcgattgaaaaagccgtctcgttcagcgaagacagcccatatccaaaaaattcggagctgctggcagatgtgtacgtgtcatatgaaaaaggaggaatgtaagagatggcgagagtcataagcatgtcagacgcgatcaatgaagcaatgaagcttgcgatgagaagagacgaaaatgtgcttttgatcggtgaagatgtcgccgggggagcggcggtcgatcatttgcaggatgatgaagcatggggcggtgtattaggggtcacaaagggactcgtacaggaattcgggcgtacacgagtgctggacactccgatttctgaggcaggctatatgggagcggctatggctgcggcatcaaccggtttgagaccgattgccgagctgatgtttaacgattttatcggcacgtgctttgatcaggtgatcaaccaaggggcgaaattccgttatatgttcggcggaaaagcgcaggtgccgattaccgtccgcaccacatacggagcagggttccgggccgctgcccagcattcacaagcgctgtatggccttttcacgagcatccctggactgaagacggttgttccatccaatccgtatgatgccaaaggtcttctgcttgcagcaatagaagataatgatccggtgttcttctttgaagacaaaacgtcctacaacatgaagggcgaggtgccggaagattattatacaattcccctcggaaaggcggatatcaaacgcgaaggtaaggatgtcacgctctttgcagtcggcaagcaggtcaatactgcacttgaagcggctgcacagctttcagagaggggcatcgaagccgaggtccttgatccgcgcagtctgtcccctctggatgaggatgcgattttcacatcgttagaaaaaacaaaccggctgatcatcattgatgaagccaatccgcgatgcagcattgccacggatattgctgcgcttgtcgctgacaagggctttgatttgcttgatgcgccgattaaacggattacagcgccgcatacaccggttccgttttcaccagtgcttgaagatcaatatttgccgacaccagataaaattgtcagcgtcacgcttgaattgcttggcgagccggcaatgaattaaaggggaacacaaatggcggtaaaagtagtgatgccaaaattgggaatggccatgaaacaaggggaagtatcgatatggaataaaaaagtaggcgacccggttgaaaagggagaaagcattgccagcattcaatcggagaaaattgaaatggagatagaagcgcctgaaaaaggaacgctgatcgatatcaaagtgaaagagggagaagaggttccgcccggcacagcaatctgctatatcggggacgccaatgagtcggtgcaggaagaggcgagcgcgcctgttgctgaagacagtgtgccgcaagccattcagcccgtcaaacaagaaaacaaacccgcagcctccaaaaaagatcgaatgaaaatatctccagtcgccaggaaaatagcagaaaaagcaggattagacctaaaacaactgaaaggaactggaccaggcggacgaatcgtgaaggatgacgtaacaaaggctcttgctgaacagaaaaaagatcaggcaaagcctgtttcggagcagaaagcgcaggaaatcccggtgacaggcatgagaaaggtcatcgctgcccgaatgcaggaaagcttggcaaacagcgcgcagctgacgatcacgatgaaagctgatatcaccaagcttgccactcttcaaaaacagctttcaccaactgcggaagagagatacggcacaaaactgacgatcactcattttgtctcaagagccgccgttctcgctctgcaagctcaccctgtgctgaacagcttttatcaaaatgagcgcattatcacacatccccatgtacaccttggtatggctgtagccttggaaaatggcttagtggtgcctgtcatccgccatgctgaaaagctatcgctgattgaactggctcaatccatctcagaaaatgccaaaaaagcacgcgagggacgtgcgggaagcgaagaactgcaaggctctaccttctccattacaaaccttggcgcgtttggcgttgagcatttcacaccgatattaaatccgccggaaacaggcattctcggcatcggagcaagctatgacacaccggtgtatcaaggggaggagatcgtcagaagcacgatcctgccgctcagcctgacatttgatcacagagcgtgtgacggcgcccctgccgctgcattcctgaaggcgatgaaaacatatttggaagaacccgcagcattaattttataggaaaagcaggtgaaaacgacatgacattagccattatcggcggcggacctgcaggctatgcggctgcggtttccgcggcacagcagggcagaaacgtgctgctcattgacaaaggcaagcttggagggacctgcctgaatgaaggctgcatcccgacaaagtctttgttagaaagcgcaaacgttcttgataaaatcaagcatgccgacagctttggaatcgaacttccggcaggtgcgatatcagtcgattggagtaaaatgcaaagccggaaacaacaggttgtcagtcagcttgtccaaggcgttcagtacctaatgaagaaaaatcaaatacaggttgtaaagggaacagcctcctttctttctgaaagaaagctcttgatcgaaggagaaaaaggaaaagaaatcagagaggcggaccaagtattgattgcctccggatcagagccaatcgagctgcctttcgccccgtttgacggcgaatggatcatcgacagcaaagacgcgctttctctttccgagattccgtcttcactagtcattgtcggcggcggtgtcatcgggtgtgagtatgcagggctgttcgccagattgggatcgaaggtgaccatcattgaaacagcggaccagctgatcccggctgaagatgaagaaattgcccgtctttttcaggagaaacttgaggaagacggtgtcgaagtgcatacctcatccagattagagcgggtggatcaaacggccaaaacagcaatatggaaaagcggtcagcgagagtttaaaacgaaggccgattatgtgctggtggcgatcggcagaaaaccccgtcttgacggattacagctggaacaggccggagttgatttttctccaaagggcattccggtgaatgggcacatgcagacgaacgtgcctaatatttacgcgtgcggagatgctataggcggtattcagctggcgcatgccgctttccatgagggcatcatcgctgcttctcatgcttccggaagggatgtcaaaatcaatgagaaacatgtgccgcgctgcatctatacgtccccggaaatcgcgtgtatcggaatgacagaacgacaggcaagaagcatatacggggatgtgaagatcggcgaattttctttttccgcaaacggcaaggcgctcattaaacagcaagcggaaggaaaggtcaaaatcatggctgaaccggaattcggcgaaatcgtgggtgtctcgatgattggcccggatgtaaccgagctcatcggccaagcggcagcgatcatgaatggtgagatgacggcagatatggcggagcattttatcgccgcccatccgactttatcggaaacattgcatgaggcgctgttaagcacgatcggccttgcggtacatgcataataaaggaaaaagcaggcacatggatataaggcgcctgcttttttatgttgaaagcgctttatttttcccctacaatagatgaaaacggcgtgtaagggaggagcgatcaaggaaatgaattcggtcccaaacgatttgcaaacctggaaacgttttgtgaaagacggtgtgcttgacgaagcccgattaagaaaacggattgcagagtcatggcatcgctgcaaaaaagctgaggtcaatccttatctagaaaaaggcccgaaggttttacagcaaacggagctggatcagcagtcaaaaaaacattcattcttcttgacgaccgcaaagccttacctcgaaaaactgctgcctgccataaaagaaatggaaatgatggcgctgttaattgattcagacggtgttgttctggcattggacggccatccccgcgcgctctatgaagccaaacgcatcaactttgttgaaggggcatgctggacggaaacggctgtcggaacaaatgcgattggcacggcgctccacatcagcgagccggttgcgatacaaggatcagagcattactccattgcttcccatctttggaactgttcagccgctccgattcaccatgaggatggcagccttgcgggtgtgattgacatatcgtgtccggcggcaggcgctcatcctcatatgctcggtattgccactgcgatcgcctatgcagctgaacgggaactcgcagcaaaaagccgtgagaaagagctcgagctgatcagccgttttggagagagggctttatccagtgtgccgatggtgctatgcaataacaagcagcacatcatcagtgcgagcataccgattcgaacctcaatgccggattggcagggccggcacctgtatgagttgaaggaacggggctactcaatcgaaaaagctatcaccataggagatggcggcacttgtttttatctttcggaacaaaagaaaaagaaggtgtttcgattcaatggagtgatcgggaaaagcggccgatcgcatgcgatgctgatgaaccttgaacgtgcagctgcggcagatgcaacggtctgtttgtcgggcgaaactggtacgggaaaggaagtcgcagctcgcgcgcttcatgagaacagtgagagacggcacggtccgtttgttgctgtcaattgcggagcgattccgtctgatttgattgaaagcgaactgttcggctatgcagagggcgcttttacgggagcgaaacgaaatggctataaaggcgcctttcaaaaagcgaatcaaggcacattatttttagatgaaatcggagaaatttcccactcgatgcaggttgcacttttacgggtgcttcaggaacgcaagataacgccaatcggcgggacgaaagaaattccagttgatatcagagttattgccgccacgcattgtgatttacgcgagcttgccgaaaacggaaaaatcagagaggacttgttttaccgtcttcacgtctatccaattgaactccctccattacgcgatcgcaccgaggatatcccggatctctttgagtactacaaacagaagaatcattggccaggcgaacttccttctgatttttgtaatgtgctgaagcaatggaagtggccggggaatatccgtgagctgtttaatgtgtttgaacgtctttctatcagatttccggacggccggctgagggatgaatcgcttcccgctttactggaagccgctggattgccggccagctctgcagaaaaaaagccggctgctgccggcgtgcttacttttcgtgagcaaatccaaaaggatatgatgatcaaagcgcttgaatctgcaaaaggaaacgtctctcaagccgcaaaaatcagcgggatccctcgaagcactttctacaaacgcctgaaaaaattcaacttgtccgctgaatcataaagcatacttccttcgggaaatggaaacattatgtatgaaggagggtgttacgatgaatattcaaagggcgaaagaaattgtagaatctcccgacatgaagaaagtaacatataacggcgttcctatttacattcagcacgtaaatgaagaaactggaacagcaagaatttatccgcttgacgaaccgcaagaggagcatgaagtgcagctgactaacttaaaagaggattaaacaaaaatggcccgcttcataagcaggccattttgttatccgcgcggcgcaaataaaataacacagacaccgatgagacaaatgaatgcgccgatccagtcatacagatcaggtgttttccggtcaacaagccatccccacaggaccgcaagcacgatgaatactccgccataagcggcgtatacacggccgaaagatgggaaggactgaaacgtcggaagaatgccgtatacaatgagaatcagcgccccggcgattccatagccggctggctttgcctctctcagccatagccaaaccagatatccgccgccaatttcagcaagccctgccgcgagaaataaaagaatggtaatcagcatcatgagcactcctcaatttgcatttatctttcattatagaggaggagagcttttaaagcttcggatgattctcaaattccttcaaatacgcttttcgctgaacctctgtaaattggctgatccaattgttttgagcctcttcactcaaatggggaaggatatagcgttcaaccgcttcgaaaaacagcggattcgcgatgatgttccaggtcgggattcgaacgattttgccgtctgttttctcgatgataatatcctcaaaaaagatccctttcaaactgtattgatggcgtcccatataaagccgcttcacctcggaaaacagcacgctgcgctttctcgagaagatttcgccactaggtccggtctttatggtgaaaatgacatttccacggcttgtgaacgcaggaaaagccataaagaatgtgatcaatccataaatcatcgccagtaatccgccgcccaaataaagcagggcatatttagattcaaacgtgagggcttcagacaccagccagactcccacaataaaggcgccccctgtagcgaggaacagccaagcccttagaaacatcatgctttttacttcaatcatgtgctgcccctaaagcttcggatgattctcaaattccttcaaatacgcactgcgttggatgtctgtaaactgtccgatccaattgcttttcgcctcttcattcagatggggaaggatatagcgttcaaccgcttcgaaaaacaacggattcggaatgatgttccaagtgggaatacgaatggtcttctgatcaacggtttggatcaatatatcttcctggaaaattccttttagactaaatttatggcggctcatctcaattttcttgatatcagtaaacgtaacagacactttgtcagtgaacacttctccattttttcctgttttgatgcggaaaatggtatttccccgcggggtgaaagccggaaagaagatgataaataaatataaacaaaacaaggtgaacagaaagccagcaggaatggctaataggtaatatttcgtttgaaacgtaatacccatataaaagagccacaaacatgctaatcccataccggcagatccgacaaaagcccatattctcaggaacattttgcttttgacttcaatgatttcttggtttttcaatgcttttctccttttgttaattcaattcttatcattgtgaaatgatttgatttacaacatccttatgagcagggaggatagaaaattcattctgggtgatgcctgtgacaagccaagtatggtgggcccccggcaggacaaatgccatgtcagccacttcaggagtgttatctttgccatatgccagacgcataagtgtatccattttccctttccgcaaagccagatcatttgcaaatcgggtaacgtcctcttggtggtcatgtttttcaaggaactcttttagatatgaagggttgtctgaagcgccctccaagagtttttcaaattcatttgatgtcaatgtcacaatcgattctcttttatcctctgtatctattatatgtaaaaactcatctgtcttagcaagtaacccttcacttgattccatttttgtaatgcgatggacttgttcatcaaaaaggagttcgtgagagtaggtgccgaattttgatacatggcaggacacattctgttcggcgccttgcccgttaaatttagaaagcttcactgtatagtcagcgtcgtttaatacatggataaacggacagtactcgtcctttaaccgatattgatggttccgatattccgctgcatccttggctaagagtgagcggcacgcggcttcaaataaggcgccgagctgttcatcttctatttccggaaaataggcctgcttcaaggccattccctgttcaaaaaacccttcgctgtaaaagcaaaacaagagttcttctatgctaattgtaaactgcttcattgtttattctcctatccaaatgaaaatttccctttaaggaaatgggttgcgccgtgtatgagcgaatccgctgttttctttgctttttccattccttttttcgcgctgtctatccctttatgtatcgatttattcgccgcatctatgccgtcattcactgatttgacgaatttgccggctgattccagcccttttttggctgtatcaacgacagcatggatcggttctttcagctttaaggctgctttttcggcaaaaccggctgtatatttggcgatttgttctccgacgactccgccaatgtatgaacctgctgccccaagaaggacagtacccacaggtcctgcaaagcttccaattgcaccgccgatgacagcaccagctgtggcaccgcccgcaacaaaaatcgtgttattcacagcatttccgacggccttggcgttttcacgcttgagaacttccggtttgtcctggtattttgcataattttcagcaattttcacgcctgctccgaatgtttcggtcgcaccggtaatcagtgtggcggtaatggcatttcctttcgcgaatctcaagcccgtttttcccacatccttcaaagtggagcgtacgccggcttcattaagaaatccttttgtgtagcttctgacgctgtttgaaaaatccaccgtgtcctgaggaaagtattttgtaaactttttatgtaccaaatctgaaaatggacggttggtcttttttaacaaatatttaggattcaaaagcactcttgccgctttttgataacgtgagctgtcaacggccctggaaatatccaagagcagttttgagtgctgggctgtatgcaagccgcttggctgtttcacaaatttcgtaagccctaatccgtaatattttccctgcgtcagcataagagcggttaagcttgtcatcgtaccgtatttgtcgtaggcattgtagagctttcgcaaaatatcatcttgttccacaaatttatcgcccgtttttctgatgaaaatctcattgtcactcagcttggtgacgagcgcctttcctgagctccacgcatcgcccactccagagaaacagctgctgtagcggggatcgcattgcaaaatcatctgccccagctccacatgcagatccttatatttgttttccatatcagttaattcagtgacaacatcatttgcaagctgttcgagcttatccggatcaactgcaatgtttcctgacacaccgttcacctcccgagtttatgtctttcctctcttgctttacgctccagttcttccattctggcaatttcagcttttcgttcttctattttgacagcggcagccttcagctcttggcttgtttcaagcagctcctgttcgaattgatcgtaggcggctttcgtttcctcgaaatcctggtcaaacgaatctcttgcttttccttgccaagcatctcccattgcagataaccgggattcaagcagcattttggagcttctgacctcttctgcggccgcactgtacttgtttgccagctcaatgactttatatgagtccaacttttgtcccctgccttttctaaattcacgcacaattggatgttttatataaatgattataaataattcggcatgtatccgaatcgtacaaaagaaccttttcataagaattggaagggcgtatattcacttaaaattcacagttggtgagactttaagattacaaaaaaggtaaaaaaaacaaatccctcagacataaggcaaatgagaaatttcccgctctatgggaaaaaacactaaagttgatcaaatgacctaagtgcgccaaacgtgttacgggacgggctatctcatggtataaatggaattgtaaacgttattaaggaggtcgtcatatgaagaaaaaatcattctcaatcgtaatagcgggcggagggagcactttcactccagggatcgtactcatgctcttggaccatttggaggagtttccgatcagaaagctgaagctgtatgataatgataaggagagacaggatcgaattgcaggcgcctgtgacgtttttatcagagaaaaagcgccggatattgaatttgcagcgacgactgacccggaagaagcttttacagatgtcgattttgttatggcgcacatcagagtagggaaatacgcgatgcgtgcgcttgatgagcaaattccgttaaagtacggagttgtcggccaggagacgtgcgggccgggcgggatcgcatacggtatgcgttcgatcggcggtgtgcttgaaatattagattacatggaaaaatactcgcctgatgcgtggatgctcaattattccaatcccgcggcaattgtggctgaagctacgagacgccttagaccgaattctaaaattctcaatatctgtgatatgccggttgggatcgaagaccggatggcgcaaattcttggcttatcctcaagaaaagaaatgaaggtccgctattacggattaaatcacttcggctggtggacatcaattcaggatcaagagggcaacgatttaatgccgaagctgaaggagcatgtatctcaatacggctatattccgaaaacagaggctgaagcggtggaggcgagctggaatgacacattcgccaaagcgcgtgacgtgcaggccgcagatcctgacacactgccgaatacgtatttgcaatattatttgttcccggatgatatggtgaaaaaatcaaatccgaatcatacgcgggcaaatgaagtgatggaaggtcgcgaagcttttattttcagccaatgtgacatgattacacgtgagcagtccacggaaaacagcgaaatcaaaatcgatgaccacgcatcatatatcgttgatcttgcccgggcgattgcctacaacacaggtgaaagaatgatgttgatcgttgaaaataacggcgcaattgcgaactttgacccgactgcgatggtcgaggtgccatgcattgtcggctcaaatgggcctgaaccgattaccgtcggcaccattccgcaattccaaaaagggcttatggagcagcaggtatccgttgagaagctgactgttgaagcatgggcggagaaatcgttccaaaagctgtggcaggcgctaattttgtcaaaaacagtgccgaacgcgcgtgtggcaagactcattctcgaggatttaatggaggccaacaaagacttctggcctgagcttgatcaaagcccgacccgtatatcataactgaaattcccccattttcgaatctgtaattgtatataatagaaagaaaatggggggatctgatatgcagctcgaagaactgatcaatcagcactacagcaaattgaatgacaacgattttcatattttaaaatatatattgaatcataagcacacatgctatcaccttggaatcgacgcgctggccaaagcttgcagtgtatcgcgttcctcaattttacggcttgcccaaaagctcggtttcagcggctacagtgaatttcgcgtctttttaaagtgggaagatcagccggaagaaggcgagaatatgagttttcaaaagctgcttgatgatattgaagcaaatttgaagttcttacggacaaaggacatgacggacatgtgccagctgattgatgcagcggaccgcattttcgtctacggttcaggaaatgcgcaaaagatatgcgcccgcgacctgcaaagaatgtttattccgcgccatcgctatcttattttaatagaagacacaaatgaatttaatctgatgcgtgatgattttaaagtaaacgatctgtttatcatcatttctctttccggagaaacaccggagctgattcctcaggcaagaatgctttctgcaaagggtattccctttatttccattacgaatttaaaaaacaatgtcctcgcccagctgactccgcataatctttatgcgacaagcaaacctgtgacattaagcgataaaacggaaattgtcgcttttgcaccgttttttctcgttggcgaagcattgttccgcgcatatgttgattacaaagaggcagaaaaaaatgacaatgagtagcagggggttctggtatgatgcaaaaaattcagcgctttggaagcgcgatgtttgtgcctgttttattattcgcgttcgccggcattatcgtcggtatcagcacgctctttaaaaataaaaccctcatgggcccgctcgccgatcccgacggtttttggtatcagtgctggtatattattgagcagggcggctggactgtttttaaccaaatgccgctcttattcgccatcggcatcccggttgctttggcgaagaaagctcaggcacgcgcttgtttggaagcgcttactgtttacctgacattcaactattttgtcagcgcgatattgacggtatggggaggagcatttggcgtcgacatgaaccaagaggtcggcggaacgagcgggttaacgatgattgcaggcattaagacgctagataccaacattatcggggccatctttatttcttcgattgtcgtctttttgcataaccgctattttgataaaaaactgcccgattttctcggcatctttcaaggctcaacatatatcgtgatgatttccttctttattatgattccgattgccttggctgtgtcttatatttggccgatggttcaatcgggaatcggctcgcttcaaagcttcctggttgcttctggggcggtgggcgtttggatatacacgtttttagaacggattttaattccgaccggccttcatcactttatttacacgccgtttatttatggcccggctgtagcggaaggcgggatcgtcacgtattgggcacagcatctcggcgaatattcgcaaagcgccaaaccgctgaaggagctctttccgcaaggcggattcgcgcttcacggcaactcgaaaatcttcggtattccgggtatcgccctggctttttatgtgacagccaaaaaggaaaagaaaaaactcgtcgcagggctgctgattcctgtcacactgacagcgattgtcgccggtattacagagccgattgagtttacgttcttattcatttcacctttcttatttgcggttcacgccgtgcttgccgccacaatgtcgacagttatgtatatggccggcgtcgtcggaaatatgggaggcggactgattgaggcggtgaccttgaactggattccgctctttggcagccacggtatgacatatgtgtatcaaattttgatcgggctctcgtttacagcaatttattttttcgtcttcagatttttaatcctcaaattcaatatcgctacaccaggacgggaaaaggatgaacagcaggaaacaaagctatattcgaaaaaggaatacagagaacgaaaaaacaaggatgaaacggcctccgctgctgaaacggctgatgacaccgcttttctgtatattgaagcgctgggcggaaaagacaacatcactgaagtcacaaactgcgcaacccgcctcagagtcagtgtcaaggatgaaacaaaagttgagtccgacagcgtattccgcgcgcttggcgcacacggcgttgtcaggaacgggaaggcgtttcaggtgattatcggattaagcgtaccgcagatgcgggagcgtgtggaaaaattactgaatgaatagtcaaaattattttatcttgcgctgtttaaagacagcgcttttttgtttgtcatacgtttgccacttataagtgcaagggatgttatgtttcttaaaaactgaaaccaatagggggagtaaaaatggaaaattatacaacgtttttaggtctttacaaacctgaaagcactgaaagtattgaaattgattccaagcttgccgagaatttcgaaacgattgatagtaaaattgggattgcattaagtaatggaataacaacttttgaaaacttaaatgaaagactcaaaatgtatgagaacagatttgagtaccttgatgaacgaaacgtaatggattatggagctaaaggagacggggtcacagatgatacgcaagcatttcatgatgcgatggccgaaggcggttatctcataaaagtccctgcaggcgtatttagggtatctggcttgctcgttccttcgaatacaatgctggttggagcgggtaaaaaaagaaccatcatcaagttattagacgatacgccagttggtcactctgtactcaccaatagtgatcatacaaatggtaatgaaaatatctacattggacatttgacactggactggaataaagatacgcgtcctgctggatggaagatccctaaggggcccacttcaagctgcttgctttttgcaaatgtggattactcttttgtagagcatgtttttgcaaaaaatgccggccttcacgggtttgatgctacaagccctaattataacagacacggagaaaatgatgatcctaccttttatcagcctggtggctgcaactttgtaaccttctcatattgcgaagcaacaggctctggcgatgataatttcacatgtcactttggaaagcatacgactttcagtcattgtctttcttaccatccgatggggttaaatgatgggtcttcaaatacaaactgttttgaaatcgatgatggctctcaggatgtaatgattgatagctgcatcgcaattggaggagttcgaggatttgaaattaaagctcatgattatgctccggctgcaaaaagagttcaacttgtgaactgccgtgcctatgaaaatgcaattagtttttgcattcggcatataggacaccacacagcaagtgatcctcaatcagcatcagctcatgacgttcagctggctaactgtatcgcatataaccctaagccgagtgatctgtacaaaggggcagggccgaatgcattgcaaatttcaggttacgatggcgtcaatgtggttaattttcatgctatatgcgatgattcctccattaactataagggaaattcagtcgtaagcgtgtattataaagggcgtctaatcaatttaaagaatataacgattcgaggatttaaaactgctgataatgatctttatattgtaggtggcgacaattctgtcggcaaggtaatgattgatggtgtgacattgatcgattcagccgaaaagggtgttgtttttgggagcggtatgtacgagtctgtagttagtaatgtatgggggcaaagatcgcctaaaaataacagcggtacagttgggattttttctgttgaccctgatcttaatgtttctaattgtgacttttcaggctacgaaacagattttaagattggcggcgttgtgacgccgtactttttgtttaaacataaaggaagcgggattattggctctcgtgattcccacgctactggaaataataattttgtagcaggatctgttcgaagcagagcaactggggctgctcaatcttctgtgatagcctcatataatacgatcaatccgaactcagactcagttgctctaggatgggcaagtgggagcacaccatcctcatcaaacagaaagatagaatttcatgcaaaagatggaacgattaaggcttcaggaagcataaaaagttcccaaacgttctcggattacgctgaatattttgagagcctaagcggtgagaaaattccggcaggaaccctagttactttggagggtgataaaattagacctgcaaaaaaaggtgactttatgcttggagttatttctgaaacagctggtgtgatacttggtgagtcaagcttccattggtctggaagatacctgaagaatgattttggcgggtatatttatgaaaaacagaaagatgccaatggccaaatcgtcatggcgcctatggaaaaccctgattataagccagataagaactatgcctctagggaagagagggatgaatggaatgttgtgggccttgtaggacaggtttatgtaagatgcgacagcacagtagaagccggagactttattcaagcgcataacaacggaattgctacaaaaacggtatctcctaaacaaaggtggcaggtcatgagagtcatcaaagagtttgacaaaagtaagggatatggagtggttttagtttttattcggtaacattaaaatgtacagattctaaatagagtgcttaacaatgcactctatttagagttttaattagattttagaaatttttcaccgcatttttatcagattatattcctcgcaaaaaggtcttcgttttaaaatttatctttttcattattcctacggttccagcaatcttcctaatttatctaagtctatccagcgcctcaactttagtagagtaaaatctttgatattttttaatgaacgcagatcagcagtgaatagctctcgaataaaagataaagtgattttggttatcgataaattcagtgcttttctatgctttcataacacttcatgacagtaaaattctttcatcaagccttataaacaattaaaataaaaagtacatattgctaaaaggggtttggaggcttttacatgcaaaaggctttgtcgtttttaaaaccatattcattgctggcgggaattgctctgattcttatgctgacggagcttgcagttgaacttatacagcctttattgattgcaaaaatcatcgacgatgggatattgaagcaagatctgcggcatgtatggatatggggcgcggtcatgatcgggctgaccgtgttatcctttgcggcggggatgctgaattccttttatgccgcccatgtcagccaaagcttttcctatgatacgagaaaagggctttttcaaagaatccagtccttctcctattccacatttggacagttttcgtcctcttcttatattacaaggctgacaaacgacgtcacacaggttcaaaatatgatttttatgagtttgcggtttatgctgcgggctcccttaatgattgcaggcggcattgtgctgtcgcttgccgttaatgtgaaactcggcttttttctgcttgtgaccattccgatcctgatcttgtttttgctgtgggtattaaggaaaggcggggcgctgttccgctcagtgcagaaaaggctggatcaagtgaacaccatcatgcaggaaaatttaatcgcaatcaagctgatcaaagcgctgcttcgcggcagccacgaagtcaaacgatttatcaaagccaacacaaggctgatggaaaaaacggtttcggcctttcagcttgtggaattcacgatgcctgtactgatgctgctgatgaatctctgcattcttttgattttgtgggcggggtcctacagtatcacgagcggaagcactcaggtcggcgatgttgttgcgataattaactacgcaacacgaattacaggcgcgctttcgatgtttccgtttttgattatgattttcaccagggcgaaggcttcaggggatagaatcggcgaggtgcttgaaacagaaggagatgagcgggaggaaggcatcatatctgatcgtttgtcaggacggattgagtttcagcatgtatcctttcgctatcctgaaatggacagagaagcgctcaggaatgtctcattttccgcaaagccaagagaaacgatcgcgattctcggtgcgacgggctcgggcaagtccacgctttttcagctcattccgcggctttatcagccggattcaggctgcatttacatagatgaaaagccggttcaagattttccggctgaagggctgcgcaggcaaattggatatgtaccgcaggaagtcctcttgttttccggcacaatcaaagaaaacatcgcttggggcaaagaaaatgcttcactagatgaaataatggatgcggccaaacatgcgcaaattcatgaaacgattttgaagctcccaaatggatatgatacagttttggggcaaagaggcgtcaacctgtccggcggccaaaagcagcgaatttccattgcgcgggcgctgattcgaaaaccggctatccttcttttagatgacagcacaagcgcgcttgacctgcaaacggaggcgaagctgcttgaagcaatcagcacataccattgcacaactttgatcattacacaaaaaataaccacggcgatgaaagctgatcagattttgctgcttgaggacggcgaactgattgaaaaaggcactcacagtgagctgctttctgaatctcagttatacaagcgcatttacgagtcacaattcggaagggaggggagcgagtcatgctaaaagacatccgcaagcctttccaatatcccaaactgccaattgacaaaaaagaaggcgcgaaaaagcgggcgaaagcaaaggatacaaagggcacactgagacgaatctggtcttacttggctgaaagaaaaggactgctcatacttgtcatgctaatggttgtcatcagcgccatattcgggctccttggcccctttgtgatcggaaaggccatcgaccattttatcgtcgggaaaacggtcagcggcttgattcccgttttgcttcttctgctcgctatctatatcattcagtctctgtcgctttggtttcaaaactattggatgattacgatctcgcagggcacggttttcagaatgagaagcgaattgttcacccatctgcatgagctgccgattccattttttgataaacagcggcacggcgagctgatgagccgggtgacgaatgacattgaaaatgtcagttctaccttaaacacgtcagtcattcaaattttgtcaagcgtgatcacctttgttgggaccattgcagtgatgctgtacatgagcccgctccttacattgattacgctgaccattattccggtgatggcagcgagcctgaaatggatcaccaaccgaacgggaaagctgtttaaagaacagcagaaaaaccttggtgatctgaatgggtatattgaggaatctgtttcaggcgcaaaggtcatcaaagcatattcacgtgagaagcagattactgctgaatttctcgaaaaaaacgctgcactcaagacgtcgggcttttgggcgcagacgatttccgggtttatcccgaaggtcatgaactctttgaataacttaagctttacaatgatagcggcaatcggcggtttgtttgcgctgaaaggctggatctcgatcggctccatcgtcgtctttgccgagtattcaagacaatttacacgccctttaaacgatctggccaaccagtttaatacgatgctgtccgcaatcgccggcgctgaacgggtgtttgacgtgcttgatgaaaaagaagagcgcgaggatgaaaagaacgccgtgcatcagcccatccaaacaggcagcattgaattccgggatgtgtccttcggttacgataaagggcagcagacactgaagcatttacagtttaccgtgcctgcggggcagtccatcgcttttgtcggaccgacgggggccgggaagacaaccgtcactaaccttctcgcccgtttttacgagcctaacgaaggaaaaattttaatcgacggtacagatattaaaacccttactagagcaagcctcagaaaaaacatggggtttgttcttcaggattctttcttatttcagggaacgatcagagaaaacattcgctatggcaggctcgatgcttctgatcaggaagtcgaagccgctgcaaaaacagcgaatgcccatagctttattgaaaggctgccaaaagggtatgacaccgtgctgacgcaaaacggttcgggcatcagtcaaggacagaagcagttgatttctatagcgcgggcggtgcttgccgatccggttcttctcattttggatgaagcgacaagcaacattgataccgtaacagaagtcaacattcaagaagcgctcgcccgtttaatggaaggaagaacaagcgtcatcattgcccacaggctgaacaccattcaaagagcggaccagattgtggtgctaaaagacggtgaaatgattgaaaaaggcagccatgacgagctgattcggcaaaaaggattttacagtgacttatatgaaagccaatttgagaaatagacctttgtcctgcacagaggtcttttttgttacagttttatagtacttttatttcattttcgtgaaatgtaacaaaattacttgacgtaaacaagttatgtatatatactagcttacattaagtaagtgataacatttatcaaggaggataaaatgaataaatcatttgaaattggcacattacttttaagagttattacaggtattatcttttttgttcacggtttatcaaagtttcagggaatggagggcaccatccaatttttcggcagcataggccttcctagctttatggcgtatgtcatcgcagcgattgaactcattggcggagtgcttgtcttcttcggattggctacacgtattgtcggtgtactgttcgctcttacactgatcggtgccatcatcactgttaagctgaaagcgccattcatgggcaatgcagaatttgattaccttctgcttttgacatccattcacctggcgcttactggaagtcgattcctggcgctggacccatttgtgtttaaaggaaaaaagaacggaaacgtttcagcataagaaaagaggcatgcagcatgaccagcattcatgaggatacacacattggctatgccaaactcacaattcgcagtctggagcgttcgcttcagttctactgtaacgtcatcggttttcaagtcttaaaaaagacggatcgccaagcggaattaacggctgacggaaaacgcgtactgcttattcttgaagaaaatccgagcgctgtcgtcttgcctgaacggtctgtgacaggcctttatcactttgcgattcttcttccggacaggaaagaacttgggatcgcgctcgcccgcctgattgaacacggcattgctatcggacatggagaccatgctgtcagcgaagcgctctacctgtctgatcctgacggaaacggcattgaaatgtacgctgaccgcccccgcagcacgtggcagcgtgatcgggaaggaaactacgtcatgacgacaaccgctgttgacattgagggccttctggaagaggcaggagatgagcggaaaacatcgcttccgaacgatacaatcatcggacacattcatctgcatgtcagtgatttgaaagaagcaaaggcgttttatacagatgtactgggctttgacattgtcggaaactatgcgggcatgtccgccctcttcgtttcagccgggggtaccaccatcatatcggcttaaacatttgggcgggaagaaatgcgccgcctaaaccgacaaatgccagcggactagactattacactgttgtcctgcctcaccaagaggagctggatttagtggcaaaccgagtcaaacatgccgggtattcgattgaagagacggaaaacagctttcgtgtgaaagaccctgtttccggcgcctatattacatttgtgatttaactgcaatccccttgccgaaaaaacggcagggggattttttattttccagaaactcctgtcaaaaatgccctgaggcaggtatgataagaagggaattgggtatcgggagtgatgagcgtgaaggctcttttttttacgagaatgttcaccttgatggtgagctgtttaatgtatctgtccattgtgaaagaggatgactggtttggatatgtatttatagcagcaggtgctgccatgtatgcagccaatcatgttttgctgacaaaagagacaaatgccatctggttttgtctgattgatattgcaatcggcttttcgttcggatttatatttcccggcacaggtttgttcattattatgctttgtccggttgcggtcgctttttttctgcgggggtttcctaaaagaacagcatggtctgtcttatgtctttcctctattttatttttgaccgtcctcatccgtacatatgcgatgttcggcaatgaatttgtcattgatcatttgactagcatgacattcgttgtcttctgcggtgtcgtgggcaaattaatccgcaagctgttggatgcgcaggatacggcaaaacagcagtttcaggaactgacggagtcccatctggcgctgtctgctgcacatcaggagctgcatttatatgcgaagcaggttgaagagctgaccgccatttacgagcggaacagaatggcgcgggaaatccatgatacagtggggcataaaatgacggcccttctcgtccagctgcagcttttgcgtgaatggcaaaaaagagacagccaaaaagcggatgagacagtaggtgtctgtgaaacacttgcccgtgaagcgcttgatgatgtccgcttatcagtacgcactctgcaaactgaaaacgatccttcgctaatcgaatcgctgaaacagctgacagaggacttttgcaaaaatgcaggagtcacaacagaatttgcggtcagcggtgatcctgcaatcattccgctgtctcttcatccgaccctgatcagaacggtgcaggaagcactgaccaatgccaaacggcacggcggcgccacagcttgttcgatacagcttgcctgcacaacggacagcatcagccttgtcattaaggatgacggaaaaggcaatcccgaagcggcacttggctttggcctcttgaatatgaaaaagcgggcagcggagcatggcggaacgatccgctttgagagcgaacgggatcaagggtttactgtaatcgccgaattttcactggctaataaaaaatggagcttcgggcccgcacagcaaaaggagaatttatcatgattaagatcatcattaccgacgatcaggatatcgtcagagaagggctggcatccctgctccagctccgagaagagctcgatgtgatcgcaacggcgcgaaacggacaggaagccttcgaaaaggcgaaagagctggagccggatatcgtgttaatggacatccgcatgccggtttccaacggggtggagggaacaaaattaatcacaagctcgctgcccggcgtaaaggttttgatgctgacaacctttaaggattcagcgctgattgctgaagcgcttgaagaaggagcaagcgggtatctgctgaaggatatgtcggcagatacgattgtaaaagcggtgatgactgttcattctggcggaatggtgcttccgccggaattgactgcccaaatgctgaatgaatggaagcgtgaaaaacagctgaaaggaataaatgagatagaaaaacctaaggagctgctcgacctgaccgagcgcgaaatcgaagttctggctgagctggggtacgggctgaataacaaagaaattgccgaaaagcttttcattacagaaggcacagtcaaaaaccacgtttcaaatattatcagcaagctggctgtcagggacagaacccaagccgccatttactcggtcagatatggtgtatctgtcttttgacatatgacgttttgcatatacgcttctctgaaaaggccttttacaggcctttttttcatgccctatgttctatctgccgctacatgccgcacgcctttctttcttctacaatggcaatggatcaaaaaaaggagtgagacgacgtgctgcaagcagaaaacatcaaaaaggcatatgaaaaaaaaacaatcgtgaaaggtatttctttttcccttcaaaagggggagtcgttcggtctgctcgggccaaacggtgcggggaaatccacaaccatttcgatgatttccggccttgtaccgcatgacagcgggaacatcacggtgggcggctatgtcatcggaaaagaaacggccaaagcgaaacaaaaaatcggcattgttccgcaggaaattgcattatatccgacgctgacggctcatgagaatcttatgttttgggggaaaatgtacggacttacgcacggtgcggccaaaaaaagagcggcagaggtccttgaatatgtcggtctgactgagcgggctaaagataagattgaaacattttccgggggatgaaacgaagaatcaacatcggtgcggctttaatgcataagcccgagctgctgattatggatgaaccgactgtcggtattgaccctcaatcgagaaatcacattttagaaacggtcaaacagctcaacgaaacgggcatgacggtgatctatacgagtcattacatggaagaagttgagtttttatgcgaccggatcgggataattgatcagggggaaatgattgcgattggcacaaaaactgatttgtgcagccgccttggaggcgataccatcattcagctcacggtcagcgggatcgatgaagcgtttcttttggcgatccgttccctggctcatgtgaatgatgtaacagtccaagagtcagagctcaaaattgacatttttgctgctcatcatgagaaagtcgtcaccagcctgcttgctgaagctgctactcatcatataaacctgctgtcccttcaggtgcaggaaccgaatctggagcgcctgtttctgaatctgaccggccgcacgttgcgggattgaggagggacggcaatgaaaaaaagcatatggatcgcatggaaagatgtcaaaatcagaatcacggacagaaaagggtttatgatgcttatcctaatgccgctgatcctaacgtgtattttaggggcggcgctcggatcagttgttgacggaggcagccggattgatgacatcaaagtcggctacattcaatcagaccagtcagatgcagcgaacatgtttgcaaaagatgttctcaaaaaaatgaagtcgataaaggccacaaaagccggcagcgaagacaagatgaagaagctgattgatgaaaagaaaatcgaagtaggcatcgtcatcccgaaccattgggaagccggcaaaacctcagctgttgtttatgccgcacctgatcaaacattgaaaagttccatcatcgaaacagctgccagctcttttatagagcaatataaagcggtaaaggaagccgcgtcagcctcaatggactacatcagcaaaacggaagctgtaaagcaaggaaaacttgaccctgcacagtttgcagaaaagctggcaaagacgctagaaaaagaaacaggtgacaagctgactattgcggaaaaatctgtcggcagcaaagccgttaccagttttcaatactattcggcggcaatgctttgcatgtttatgctgtttcatatcacagtcggggcaaaatcgtttttacaggaaaaggatacggagacgcttgccagaatgctgatgacgcctgcgcaaaaatccgtcattctcttcggaaaatggcttgggacgtatctgtttgccatcatacaatttttcatatttctgatcgtcacaatcaatgcatttggtgtggactggggaggtaatttgctgtttgtgagtgtactcgggctttcttacgctgccgctgtatctggcatttcaatgctgcttgcgtcgtgcatcagcgatatgaaatctgcagatgcgataggcggcttcggtattcaattgcttgcggttctcggcggatccatgctgccgctgtatcaatttccggacgtcttgcagtccgtatccaaagcggtgccaaatcgctgggcgcttgacggctttctttctttaatggaaggaggaggctggtctgaccttcaaaagcctgtgcttctttttgcggcgatcggcctttgttcacttgtaattggtatcagacggcttcatacaagataaggagggtacaaaaggtgaaaaaaatcatagccatttgcggcattgagctttctctcatttttaagaagccgcagaactatttgatcatgtttgctgccccgcttttgcttacctttgtatttgggagtatgctcggcggcaatgatgataaggtgcggcttgcaatcgttgatcaggacgatacgattctctcacagcattatattcggcagctgaaggcacacgatgatatgtatacattcgaaaacgtgcctgaaaacaaagcgtcagaaaagctgaaacaaaagaaaattgccgggatcatcgtcatttctcgctcgttccagacacagctggaaaaaggcaaaaatcctgagctgattttccgtcacggccccgagctgtcggaagcgccgatggtcaaacaatatgcagaaagcacattggcaacgctcaatattcaggtgaccgcggcaaaaacggcatctcagacagcgggagagaactggaaggcggcgtataaaacggttttcgccaaaaaacatgaagatacagttccggctgtaacacgacagacgctcagtgataaaaaagagggtgtggaagcaagtgacacagcctccagagcagcagggttttccatcctgtttgtcatgctgaccatgatgggagcggctggaagcattttagaagcaagaaaaaacggcgtctggtccagattgcttacagcctctgtcagccgagccgaaatcggtgctgggtatgtgctttccttctttgttattggctgggttcaatttggcatattgcttctttccacccattggctgtttggcatcaactgggggaatccggctgcggttattgtattagtgtcactttttctattgaccgttgtcggcattggattgatgattgcggccaatgtcagaacgccagaacagcagcttgcgttcggcaacttgttcgtcattgcaacatgtatggttagcgggatgtattggccgatcgacattgaaccgaaatttatgcaatccatcgctgaatttcttccgcaaaagtgggcgatgagcgggctgacggagattatcgctaacggtgcccgcgtcacagatattctcgggatctgcggcatcttgcttgcttttgcggcaatcactttcgcagcggggcttaaggcgctccgagcctaaaaaacatctgcctaatggcagatgtttttttgcatgtgggtaaacccacgcattacgtatgaatgcagcctgaaggccgctcccggttaatccttatcgatcatagctaatatcgattccagccaagaaacgtaatttttctcccgctccagcgctttcgtcagcacgaggtagtggccgaagtccggtgaagaaaacgacatcggctctgctgaagccataagcttttcatagctttcctgcaggtcagacagcttggccttgcgttttagaagctggtctgtaaacaattctgaagcctcctgccgtgatagagaagaaataaagtatgccttcagcataaattcatccttcaccgtctccggtatcggatgatggcggatcagccagtcatgcagttcctgctttccgctgtctgtcagggtgtacatctttttctccagctttgtgccctgaatcgttgtccgaaacgtgataaatccttcatccgtcagctttttgagctcagggtaaatctggctgtgcttggcgctccaaaactggccgagctcctctttaaaataactcgtaatatcgtatccactcaattcgccttttcgcaaaagccctaatatggcgtattttaatactctcatgctatcctccgtgtctggctgtttcgcaaaacagatgagccggtgctcaactgtgattctaactgcctattccccttattatagaaaagggaggaagggaacacaaccgggctctttggaaatgaaaataaaaggtttgtcagaaggtatccgatttatctccgtcaatgatataaaagagatttaaatttaattttcagaaaaaatattaactatattgattttttatgtataataggaaattggtggtatcagcattttaagggggaataaacgtgaaaaaagtacttatggcattcattatttgtttatcgctgattctatctgttttagccgctccgccgtctggcgcaaaagctgaatcagtacataatcctgtcgttcttgttcatggaataagtggtgcatcatacaactttttcgctattaaaaactacttaatttctcaaggctggcaaagcaacaaactgtacgcaattgatttttatgataaaacaggaaacaacctaaataacggcccgcagcttgcttcatatgttgaccgtgttttaaaagagacgggggcaaaaaaagtagatattgtggctcatagtatgggaggcgccaatacgctgtactatattaaatatttaggcgggggcaataagattcaaaatgtcgtaacgcttggaggggctaatggtttagtgtcatcaacggcgctgccgggtacagatcctaatcaaaagatcctctatacatctatttacagtctcaatgatcaaattgtcatcaatagcttgtctcggttacaaggagcgcgaaacatccagctttatggcatcggtcatattggcttgctctctaatagccaagtgaacggctatatcaaagaagggctgaatggcggaggcctcaatacaaattaatatcttcataaaaaacctgcagtctccgttacggcaggttttttgcatttttctagcaatctcgtctgagaaagatacaccaataaggcagaggggtttatgaccttagtctatcatgcatacgtcaatttatgacatcaggcactttttcaaatagagcggacatgttaaggtacaaccatcgatttctatcaatttgaaataaaaggagcggtgttatgcaaattaaagaaatttttatgatccgctgcatttcgtgcttaagtgtcgtcttgctccatatcatttcaatggtactgatgcttcaggcagaagctcttgcagatatttctcacactgttgattctttccgaacactcctgatgttcagcacgcccgcttttattttcatctctgaatttttactggcccgttcttatcctgatggggtgcctgacggttttttaaagaagcggggaaaagtgatttttgttccttttttatttatcgcggccatcgatgcgctgctgatgaccagtgcgatgggggagaggtaacctttctcgcgtttgtgcaaaaatatctggcgaacgtattcttaggaaactttatcggatacttcattctcgtcatctttcaattttacatgctgcatatgatgtttcatgagtatttgaaaaaagcatcgccgaaatgggtgctgtttatctcatttgtggtgacagccgcttatttaggctatttctccgcagccagcccggctcctgcttctgaagagggcggggcatttccgttcttctgggttccgttcgcaggctggcttttctacttttgtctagcctactattgcggaaaagaatacaagcgttttttagcgctgctgaaccaataccgctgggtcgtatacggttgcgcaattgcttctggggcgctggttgtcactgtttcttatgtgggtgaaatcggcatgatcagctcgaagcggcctgatatcatgctgtattcaacaagcatgattttcctgtgttttcacttgttttccaaaatgaagcatgtgccgaaaatcatgatgtttatcagcaactattccttttcgatttatctgcttcatgcctattttatgattataggctacgtgttgcttttgaatatgcccgaaattcccgccgtaccggctgttctcctgctgtttgccgtgtgcacagccggcccgattctgacctcgtgggcactgaataaattcaaatacgggtatttatttgtggggaaaatttatcagccaaaacagaagaaggtaacagtcgaagtgcgtgatcacgcagggtgaaaaacaagcggcaggagggctcctgccgcttgttgtgtattaaatcatacagtatacacaatctttttcttgtaaaataaaggagaagagtgaatagaagggagaacattcatgacatcagtcaatctaagctacccaataggagaatacaaggcgagggaatccatatcgaaggagcaaaaagataaatggattcaagtacttgaagaagtgccggcaaaattgaagcaagctgtagagggcatgacggacagccagcttgacacaccgtaccgggacggtggatggaccgttcggcaagttattcatcatctggctgacagtcatatgaacagctatattcgttttaaattgagcttgacggaagagacaccggctatccgtccgtatgatgaaaaagcatggtcggagctaaaagactcgaaaacggcagatccgagcggctcactcgcgcttttgcaggagcttcacggaagatggacggctctgctccgcactctgacggatcagcaatttaagcgcggattttatcaccctgatacaaaggagatcattaccctggagaacgcgctcggcctgtatgtctggcactcacatcaccatatcgctcatattacggagctttccagacggatggggtggtcttaacgcttttgccggtggaaagccggaatactgatagcagcaatcaccagaagtgagatcacagcagccgctgcatataactgatcatagccgctggcgacactcgcatgaatggcgtcgcttatcgcggttttgacttcaggaacgggaatgcgttcgatttgttcttgtaaagaagaaacatcagaactgtcgatctccggaatcatctgcatcgccttttctgaatatccgctgtccgataagcggctgttgatctcatcacctatttggtcaaacccggctgtgataaaacctgcataaagagtaggcgccaaggtcagtccaatttgccttactaatgaaagcgtgccaagagctgtacccttatttgtttttgccgcttctgatacaaggacgttcagcggagcgcctaacagaaagccaaaaccgatcccagctgccacacttgcgatcataaactcccatttttccgtcacccagaacggaaataaagcaaaccccgcacatgagatgattcccgaaagaataacggtttttacaggaccttttttgtcggtaagcgctccgccaagccaagcgccgattccggaagccaacgcaagcggtgtcatccaatagcctgcttttgcggcagggacacccaaatactgctcgacatatgacgggataaaaatgactgccgccaagagccccccggataataaaccaatgataagcgtgcgctgaaacatatggtttcgcagcagagaatacgccaaaatgggatcgcctcctcgcatttcaactctcttttcatacgagataagcgctgcaaaacagagtaggccaaaaataatacatccataaacctccggattccccaagctgtgtaagagatttgccccgtcaaggttcgtcatgccgtacatcacggctaaaatcgacagggatagaaggaagattccggccgcgtcgaggcgcttagcttcaggtgcttttgtttccgcgataaagtatgagccgaaaacaaccaatagcacggcaatcggcaaattaatcaaaaacagccaatgccaagacccggtccaatcaagcagaaagcttccgatatttggcccgagcacagcggccatcccgttcattgcgccaagcagcccaagcgccttcccctgtttttcctttggaagggtcgcgagaatgtgagagctgccgatgatgaaaatcccgccgcctccaagcgcctgaatcagccgcgatatcagaaagagcgggaagctttggctcaaagcaacaagcaaagaaccaagtccgaacaggcaaacctcaatgagaaagagtttttttctgccgtagcggtcggaaagctttccgacgattggcacactgacgctaagaccgagcgtataaagggtaatgccccatgatccccaggaaggggaaacggcaaacgactcgtttatcgttgttaaggcagctgaaataattccgttatctagcgcagccataaatacaccaaccgtaaacaggctgatcgcccacttttggcctttctgctctgttaatgcttcagacatattcatcaacccctttttttattcactcaaagtatattattcattttaaatgaactaaatgtcaaataaaaaaagcctgctcccgcagtttgcggatgacagacttacagatttattcttttttcgctttctctaatgctcttgaaaggatagacagcccttcggaaaccgcctgcttttcttcaggggacagcagctctaatgaacgcttcaatttcaggtggcctttttcatataaaccccggaaaatctttttcgcattttctgtcaactgaacaactacagagcggcggtcctcttcagaatgtgagcgtttgacaaaccctgatttctcaaggcggtcaagcagcccagttgtattggacagggaagcccccattttttcagcaatgtcgctcactttcaatgttccatggttgtttaatagcatcaacaccttcatttgcggcatgctcatatccagcttcatccactcggacacatcaccgaggccggcggaagttaagactttcatatagagcacccatatttcccgttcctccgatgaaagaatgttttcgtttaatactgttgtatcgtgtaaattatattccatttcatcacttcctcatcattcactcctcttaccatattactcgattttcactcctgaaagaaagtgagcagaaaccgcatgcgggactttgtccgaaaaataacggtagtgtataatgagttggagattattgggggagaggatcgaactagaatatgattggagagaccattgctgattaaaaagaatgctttatcaatattaaaaatcgtttttcctattgctgttttgctatttgttatttatcaatcgaaaaaagaactgacaaatctgtcattcaaacgtacgctcatggtcatcaacggactggaacgaacggacttattcatgcttgtgttgatcggcttgctggctgttgcggctatgtcgctgtatgattacgtcctgaaatactcactgcgcctatcgatcacaaacggaaaagtattcagggtttcctggatcgccaactcatttaataatgtgctgggattcggcggtttagccggagtcgggttaagaatgatgttctataaggagcatacgaaagaccataaggcactcgtgaaaggaatcgcctggctcacatcatctatgctgctcggattatctgttttcagcattttcgtcgctgcgagagtgctgccagtggatgaagtgattcatgagaagccttggctgtgggcggtcgttatcggttttgcgctgatattgccgttatctttagcggtgtccaaaataaaagggcgcaaagctggggacgaagagaatgcggacaaagtgaaaaatccgattttcgcgtatattggagcttcagttgttgaatggctcatggccgggatcgtcatttattttgctttgttcgctatgggcattcatgcagatatcaggtatgtgttcggggtgttcgtcattgcggcgatcggaggaatgatcagcctcgtgccgggcggcttcggctcgtttgaccttttatttttgctggggatggagcagcttggctatcatcaggaggccatcgttacttctattgtgttgtacaggctcgcctattcatttatcccattcatcttaggcctgttctttgccgcaggcgacctgacggaaaatacaatgaagaggctcgaaacgaacccgcgcatcgcaccggcaattgagacgacaaacgttctgcttgttgttcagcgtgcggtattagtgagaattttgcaaggctcgctttcccttattgtgttcgtagcaggtctgattgtcctggcctcagtttccttgccgattgacaggctgacggttataccgcacattccgcgcccggcgcttttgctgttcaacggcctgtccttaagctcagcgctcattctgctgattttgccgatcgagctttataaacggacaaaacgttcctatacgatggccattacagcgcttgtcggcggctttgtgttcagctttttaaaagggcttaacatcagcgcgatatttgtactgccgatgattatcgtattgcttgtgctattgaaaaaacaatttgttcgcgaacaggcatcctatacactgggacaattgatattcgctgtggcgctgtttactgtggcgctctttaactacaatctgatcgcgggctttatttgggaccggatgaagaaggtgctgcgtcacgagtatttcgtccacagcacctcgcatattacacatgcaaccatcatggcgatcatcattgtgccgctgttcttcttgatatttacagtggtctatcataagagaacgaaaccgatcggagagaaagctgaccctgagcgtcttactgcgtttctcaatgaaaaaggcggcaacgcgctgagccatcttggttttcttggagataagcggttttatttttctagtgatgggaatgcactgcttctgtttggaaaaatcgccagaaggctggtcgtgctcggcgatccgtctggccaaagagaatcattcccgctcgtgctggaagaatttctgaacgaagcgcatcagaagggattcagtgttttgttctatcaaattgaacgagaggacatggcgctgtatcacgattttggctacaacttctttaaattgggcgaggaagcatatgtagatttaaatacatttaccttgagtgggaagaaaaaagccggccttcgggcaatcaataaccgctttgagcgggaggagtatactttccatgtggatcatcccccattttctgatgcgtttttggaggagctgaagcaaatctcagacgaatggctcggctcgaaaaaagagaagggattctcgctcggattttttgatccttcctatttacagaaagcgccgatcgcctatatgaaaaatgcagaaggagagatcgttgcattcgcaaatgtcatgccgatgtaccaggaaggagagatatcggtcgatctgatgcgctatcgcggcgacgctccaaatggcattatggacgcattgtttatccgtatgtttttatgggcaaaggaagagggctgcacgtcatttaatatggggatggcacccttggccaatgtcggcactgcctttacatccttctggtccgaaaggtttgccgctgtcatttttaataatgtcagatacatgtacagcttcagcggcctaagagcctttaaagaaaaatacaaaccggagtggcgagggaaatacttggcgtatcggaaaaacagatctctttctgtcaccatgttcctcgttacacgtctaattggcaaaagcaaaaaagactccgtctaataagacggagtctttttttatttcgtttttaagaagtaggtttcaatatcatcaagcagatagtttgcggctttaattccgcctgcggttgtccacacgacgtcatcgacttcatgtgcattacctgacttcacggccttcaggtttttccatagtgaactgcttgtccactgattggcccatttttcattttcctttgcattatcggctttataagtgaaataaaacagcacatcagcatccatatcaggaatggattctttactgtcggttgagaacgtaaattggtccttttgtttcttgaacagttctacttgtttttcagggcgtttgaagccaagctggtctaaaataatcccaggaaatgaatcggtataatagattcttgattcaccggataaaaagcgtacgacagaaacggttttgtttgtctggtcgcccagcttgttttttaaatcagaaacgcgtttatcaaaatcggcaatgacttccttgcctttgtcagccttattcaccgcgttggcgtatagagtcaggttatccttccagttcccagccaaagattcagcgaaaacagtcggcgcaatcgcatttaactgatcataaattttttcttggcgcactttgtttccaataatcaaatcaggctttaattctgcgatggcttccacattcggttccgtttcaagaccgacgtttttaacgcctttcatgtcatctttcagatagtcataccacgggtcgcccttccatgactttacggctccgaccggcttaatgccaagcgctaagagcgcctctgttccttcattagttaaaacaacaatccgttttggattggcgggaatgttgtctgatgtccccattgcatgtttgaccgttctagttttgctgcttgacccctcactgttacttgaactttctgaactattacaggcagaaagtactataacggccattaaaaatacgaatagcatgctgatatgctttttcatctttttcctcccaatattgaaattcattatcatttagatcataataagcagtgttaagagtgtcaatccctaattgaggattattctcaaaaacaaacattacatagtaaataactaggagaattagatcatgatctgcaaaaaggcatcttcaaaatggattgtgttagtatgtctgattttcattttactggcggctgtctgcgcaagcgtcgtgtacggctatacaggtacgtcatggagacaggtctatcaggcgtttacttccttcaacggaacaaatgagcatgtcatcatcaaggatgtcaggcttccgcgcgctttggttgccacagttgtcggcgcctcgcttgcagccgcgggcgctctcatgcaggcgctcacaaaaaatccgcttgcgtcaccgggcattttcgggattaacgccggtgcaggtttttttattgttgccggatcgttttttctgcatattcagtcacctcaggcattagtatggagctcgtttctgggggcagcatttaccgccgcgatcgtctatgcagcaggctcgcttgggagggaagggctgacgccaatcaaactgacgctggcgggagctgccatggcggctatgttttcttctctgacacagggcttgctttctgttaatgaactcgagcttgcccaggtgcttttttggctgaccggctctgtgcagggccggagtctggatctgctgatgacgatgtttccatatgcagcggcagcgctggtaatctgcttctttctcggccaaaaaattaacctcctcgttatgggagaagatgtggcaaaaggacttggccaaaaaacaggcctgttgaaatttgtgatggcgctttgtgttgtcatgcttgcagggtccgctgtcgccattgccgggccgatttcttttatcggcatcattattccgcattttgcccgctttgtcgttggtaatgattatcgctgggttctgccattttccgctgttttaggtgccattttgcttgtttgtgcggatatcggtgcgcgatatatcattatgcctcaggaagttcctgtcggggtcatgaccgccatcatcggaatgcctgtgtttgtgtacatcgcaagaaggggggcgaagctatgaaacttcgttttggcgttactgcggctgaaaagaaagcatggatcgtatttttggttttactggggttaacagctgctgtactcatcataagcgctggtctcggacaaaggtttattcctccctgggatgtagcaaaaacattctttggtgcagattccaagctggatgaactgatgatcatgtcgttccgcatgccaagaattttgacggctttatgcgccggtgtctgcttggcagcggcaggcgcgatattgcaggggctcgtcagaaaccctctcgcatctccggatattatcggaataacaggaggagcggcggtagcggtcgtgcttttaatgatgttcttctcagaccgcagcagttcacttacgatcagtctgtcatggcttccggcagccgcatttatcggcgcatcggctgtcggactcatcgtctatttactggcatacaaaaatggtgcctccacatttcggctggtgcttatcggaatcggattttcaatgtcggcgcaggcgatgactaccctgctaatgatcaaaggtccgatttaccgggcatcacaagccaatgtgtatatcactgggtcagtttatgggtcaaactggcagcatgtaaaaatagctattatcttatctgtcattctcttattcatttgttttgtcgcgctaaaaaatatgaatatacaggtgctgggtgaagatattgcggcgggttcaggaagcgctgtgcagcgaaatcgttttttcttgctccttttgagtacggctcttacgggttgtgcagtttcagttgccggcacaatcggttttgtcgggctgatggcgccccatattgcaagacggcttgtcggctcatcttatggcgcgctgctcccaacgtcggcacttattggagctctgctcgttttaacagctgatatcgtcggcagaaccttatttgctccggtggaagtgccggccggcgtctttacagcggctatcggcgcaccttattttatttatttgctctataaaacaagaaattcttgatcgttacacccattttcttaaaaaagaaaatgggtttttttgataatgactgaaggttcgtaattatttttgctatactgacagagacattgataaagaaagggcggcagatgaatgaaagaagcagaggtattaaaatatgaagcatttacaagcagtcccggcaaaggaaaccccgcaggcgtcgttttgcagggagacgattatacggaagacgagatgcagatcatagctgaacgtgccgggtattcagaaacctcctttatccgaaaaagcgagtcggccgatcttgaactccgttactttacccctggacacgaaatgaatttgtgcggtcatgcgacagttgcttctctttacgcattatgtgagaaaggaatgctggagagcggtaaaacgtacagcatccaaacgaaagcgggtatcctgcctgtgaagatttctgaaaaagatggccgtattcatatcacgcttgaacaggcctctccgcaattcaaaccatttacaggcgatcggaaaaaacttgcggacgcactgggtatcaccgatgaagattttcatgaagaccttccgattgtgtttggcagcactgggatatggacagccatcgttccgcttaaatcattggaggcttccaaaaaaatggtaccagataacaaacaatttccggaagtgttagttgatctgccaaaagcttcagtccatccgtttacctttgaaaccgtccatcccgacagcgacctgcacgggcgccacttttcatccccatattcgggaacgattgaagaccccgtgaccggcacagcatccggcgtgatgggggcttatatgaaacattatggcaataccgagcagcataaatttatcattgaacaagggcaggaaattggaaaagacggaaaagtggagatcgaaatgaacgaagccggcggccatgtgaaagtgaacatgacaggaacagccgtttactcagaaacccgtattcttaaaatctaatacggatgatggtttacaaaaagatgcactttccgttatcattatgaaatgataatcattttcaattgcataggaaggtgagacggtatgcctcaaaccgaacaaatacatcagcattcagtactgcgggacatcatacgcagcagaagatcgattcgaaagtttaaacaagagccagtaccttcagcagtcattcttgacatgcttgaaacggcaaaatatgcgccaaatcacagagtgacagagccatggagatttatttacgtttccagtgagacaggtaaagcgaacctcattaatacatttgcagcgttctctaagaaatccaagccggatatgacagaggaaaagcttcaaaatttcaaaaacacacttgggcgcgttccgggatttctcctcgtcgtgtttcaggaagatgaaaacgacagagcgcgggacgacgattttgcggcaacaagctcgttgattcaaaaccttcagcttctcgcttgggaaaaaggaatcggcatggtttggaaaagcggaaaaatcctttatgacaaagaagtccatcaggcctttggtttgcaggataatgagcgtttcgccgctatcatacaaacgggttatcctgacgaggcgccggaagtgaaaaaacgcacaccgatccgcgaccgattcactgaaatgtaaaaaaccccttgtctcaaacggagacaaggggtttttcattaacgagatttctttttcgctctgttgtcggctgctttcgcacgctcttgcgcttcgcggtcatctgcatcagcaagctcggttgaatattcttcgtaaacgccgtcagtttccctttttaatgcatcgggaacttgtggaagcttttgtttgtttttatcacggtttttgtggatatgatttctgcccatatcaaattccccctaaaaagtgatatcaaacaaatatagtatttggttttaaggggctatgtattcctacttccgcttagcagctttttccgcttttttaaattcgcctgaataaagaacttcctgcattttcttcaggttggcgccttgctggtgcttctccctctttttttccataaaaaggacctccttcaaccatgttattcttaaggttgacgcttcctgctgtttttatacagtctttcggtccgctatcagctgtgagagtgcaaattcaagatccgaatatgtaaaacgaaatccagaggttatcgcttttttaggaagagcgcgctgtcctttcacaatcaaaagactcatttcacccaatgcttttgataaaaagaaatccgggacggggagccagtgcgggcggtgcttcacccgtgcaatcgcttttccgaattgcttcatgtccacaggattgggcgcggtgacattcattgggcctgagatgccggcattttccaccgcatatcggatcatctgggccgcatcctcgacatgaatccatgacagccactgccttcccgttccgatcgttccgccggccagaaacttataggggagaaccataagcggtagagcacctctttctccaagcatcacgccaaatcttgcataaaccgtccggatgcccatcgcttcaatattctgtccttccttttcccacaggtgtgcagtatggctgagaaaatcctcatctgacgttgcagaatcttctgtgaaagttttctcaaggcttgtcccgtaaatacccacggcactggcttggatcaatgtcttcggcttctccttctgtttctgaataagccgctgcacttcacgcgtcgcattgatacggctggagagaatgtgctgcttcgttttttctgtccagcggccaaaaatcgattttcccgcaaggtttatccagacatcaatatgaggaagttcctgctccggggcggctccttccgtcagccattgcacatatgtcatatttttttgttcagtttctcttgcgtttcttgataaaatataaacatggtgtccctggcggataagaacgcctgtcagatgctggccgagaaaaccggttccgcccgtcattgcgatattcatgaacatctctcctcatcgttctaataaatatactttacctcattgtaataaaagaaaacgcgtttcaggcctgagaagggagattaagatgccgtttattacaaaaatatcaacgcaaaaaaagaatacggaacgcttcaatatttttctggatgataaatacgccttcagcgtggacgcggatgtgctcgtgaaatttgagctcaagaagggaaaagaactcgatgatcttgacatcattgagattcaatacggcgatgaagtgaagaaaggcttcaaccgtgcgcttgactttttatcctatcgaatgcggtcgacgaaagaggtcgaggaccacttaaagaaaaaagaaacctcgccccccgtcattgcggaagtcatccataggcttaacgattacaagtacttaaacgaccaggaatttgcctcagcctatgtcagcactcacaaaaaaacaaacggaaaaggccctgatgttttgttcagagagctaagagcgaagggaattgatgacgatacaattaaggaggtgctaagttccttttcctttgaagatcagacaagagaagcggtcaagcatgttgaaaagcttctcaaaaaagataaaaagctttcgacgaaagaactcaaacagcgcgcccagctgcagcttcagcgcaagggcttctcatttgatgttatcagcgcggcgatggatcagattgaatatgaaaatgatgaagacacagagaaagaagcgctgcgccttcacgcggaaaaagcgtttagaaaataccgctatgacggctcatatgaaagcgccatgaaggtcaaacaatttttattccgcaaaggattctcactcgatttaatcgagcaattactgcaggaagaggagtactgaaatggagaaacgatacagtcaaatgacacctcacgaactcaataccgaaatcgcattactttctgaaaaagcaagaaaagccgaacagcatggaatcataaacgaactggcagtgctcgaacggaaaattacgatggcaaaagcatatttgctgaacccggaagattactcaccgggagaaacatatcgtgtggaaaacactgaggacgagtttaccatcagttatttaaatggcgttttcgcatggggatacaggacctcttcccctcagcaagaggaagcgctgccaatctcagtattgcaagaaaaagaataaagcgtaacaggaggctgatgatcagcctctttttgtttgcagcacatttacacgaattcttaaagaaaaaatcattgaattcacttgaaaaatcttttaagatgaaactcgttgttttttaaaatcaaaggaggcgatgacgttgagtatcaaaaacccatctgtaaaatttattatatttgttcttatgatttgtacattttcaatcggctatacagaatacgcggtgatgggtattttgacgtcgattgccaatgactttcatatacaggtttcatccgcagggcttcttgtcacggcttatgcggcaagcgtttgtttgacagggccgctcgtcaccatcatttccgtcaagcttccgagaaagcctgtgcttcttgggctgatggcgatatttatcctttccaacctgatgagcgcactggcgccgaattttgcggtattggccatttcaagaattttatctgcgtccattcacggcgctttcttcgcgattgccatggtattcgcaagtgaaatggttccgccggaaaagcgtgctgcagctgctgcttcaatgaacggcggactgacagtggctctaatgcttggtgttccattcggctcttatctcggagatgtcctgaattggagagcggtgttttccatcattacggcacttggtgtcatcggatttttaggccttatggctgccgtgccgaacagaaaaccaaaagtgatcccaatgcttatgaatgagtggggggtttttaaacacaaacaagtgctgttttccttcgcgattaccattttaggctattccggtgtctttatcgcctacacctttatcgaacccattttgaggcattcagccggattcagcacggttggcattacaggtgctctctttgcgtatggattgggaggcgttgccgggaatttctttgctggaaaggtaccgctgcctttgctgactcggacgatgatcggcgtaatgatcggtttaatcggtgttctggctgtatttccttacattgccatttacccggctgcagccattgtggcaacgttcctattcggggcatgcgcattcggcacgccgcctcttctgcaaacaaaggtcatttcctcatctgagggcggcacaaccattgccgcagctgtcagcgtatcagcatttaaccttgccaatgcccttggtgcatggatcggcggaatgattttaaacggaacaggctcttattcctggctgtttgcaggaggtgcgcttatgaccgcatgcggacttgtgctttctaccttcgcacacttatcagaaaagaagagcgtctacgaatatcaagtcaataaagggtaaaaacagctgcagtgtatgcagctgttcttctttaccgtttgcctgaggctctcattctttcttgaggatgctgattgatagatccgtcagcacgctttgaagcataatcgtcctttgctctcggttcaccctgaaatttgttttcgttttcgtaaggaaatcctttttctttatttcggaccatgtcatatccccctagattcgagatcaaaaagttgcgtctttccagatgaagacgtaaggttagtatatggagaacactacgtaataaagcgttatttttttcctgaagaaaggagactgcacacatgaatatgtacattgagaaactgactaatctgcttctggaaaagaacgagatgatcagctatatacaggcaaaaacgtgggtggaattgttatggagcgatttcgaagcaacctatgcaaaagccggacacgcctatcaaggtgaaaaaatgactgaaaaaatcgtcacacaatggattgaaaactatggcggccagctccacctttttcaaagctcccgtaacgacgtgaatgattacttaaatcaaagcagaggccttttgcattaaaaacctgccgttaacgaccggcaggttttttcattttcttaaaattaccttaacaggaagaaatcataaacaaaacatgtttcaccagcctgtcaatcagggaataccacttatatcttgtcaaaatgcgaggaggagctttatatgaaaaagaaacaagtaatgctcgctttaacagctgccgcaggactgggtttgacagcacttcattccgctcccgcagcaaaagctgcgccccttcacgacatatctgtcagcatgccatcatccgatacttacatcataaaagcaggaaaactgaatgtccggactgagccaaatcatgaaggtgatattctcggcactgtatcatcagaacaaaaggtaaaagtcgataggttcgtaaatgccgattgggctcaaatttatttcaaaggaaagaaagcatatatttcaactcactttttaatgaaaaccgcaagccaagcgaaaacaatgaaacagacagccttctatgcaccgacgcccgaaaatggaaaagctaaacagctctcatctggaacagaggtgacaatacttgggtggggattcagtgaaaacggcggatttgacttcacttgggcgttcgtggattatggcggagttaaaggctatattcacacaaaggatttacaaatgcgataaaaaggcaggccgaggcttgtctttttgcctatgcatgaaacatttcttctttctgcacgtaacaatgagaaaggagatgatgatatgacgggtttagtcggcggagggcttatgatcattgcgggcatactgatcaaactgtttcctcccaaatcgatcaacagtgtgtacgggtacagaacgagacgctcaatgtcagatcaaagattatggaatgaagcgaaccgttacagtgcatcattaatgatcctgtcaggcttggtgattgcgggaatgggtttgctgctgggatcaaacttgtttattcttcagcttatcctgctgattgccgcctgtgtcataacatttatgctgacggagaaaaggctgaaaatcatgacgcacagtcaaggaggagatagaagtggacggagttaaatgccagtttgtcaatacgaacggaatcacgcttcacgttgcagccgcaggacgggaagatggcccgttaattgtcctgctccatggatttcctgagttttggtacggctggaaaaatcaaatcaaaccgcttgttgatgcgggttaccgggtcattgctcctgatcagcggggctacaatctcagtgacaaaccggaaggaattgattcgtatcggattgatacattaagagatgatatcatcgggcttattacgcaattcactgatgaaaaagcaattgtcatcgggcatgactggggaggggctgttgcatggcatttggcttccacacgcccggaatatcttgaaaaactgatcgcgatcaatattccgcacccgcacgtcatgaaaaccgtaacgccgctttatccgccgcaatggctgaaaagctcgtatatcgcatacttccagctccccgatataccggaggcatcactaagggaaaatgattatgaaacattagacaaagcgattggattatccgaccgtcccgcgctttttacatccgaggatgtcagcaggtacaaagaagcgtggaaacagccgggcgcgctgacagctatgctgaactggtacagagccctcagaaaaggaagcttggcagagaaaccctcttacgaaacagtaccttaccgaatgatctggggaatggaagaccgctttttgagcagaaagcttgcgaaagagacggaaaggcattgctcgaatggacatctcatctttgttgatgaagcttcccattggattaaccacgaaaagccagccatcgtcaatcagctgattttggaatatcttaagaaccaataagctaaaatttctctccatccgtctgtcataatggcagactttttctgtgcgttttttttcatagtctgttttaaacatgacaaaataacattaaaaatcatgaatgtcaccataaaattgtaacaaaaaacaggtttaaacgactttaaaaaaaggaatagccttactgaagatttgtgtaaaactcccctaaggcaatacttaaaaagaataataaaaagaaggtgccttaatgaagcaaggattaatctcgattattatcccgtcttacaatgaagggtataatgttaaactcattcatgaatctttaaaaaaggaatttaaaaacattcattatgactatgaaatattcttcataaacgacggaagtgttgatgacacgcttcagcagatcaaagacttggcagcgacgtgcagccgggtaaaatatatatctttttctcgaaactttggaaaagaagccgcaattttggcgggctttgagcatgttcagggcgaggcggttattgtcatggatgccgatctgcagcatccgacatatttgctaaaggaatttatcaaaggctacgaagaagggtatgaccaagtcattgcccaaaggaacagaaaaggggacagctttgtccgctcactcttatcatctatgtattacaagttcattaataaagcggtggaagtcgatttgcgtgacggtgtcggtgacttcagattgttaagccgccaagctgtgaatgcacttttgaagctgagcgaaggaaaccgcttctcaaaaggccttttttgctggattggctttgatcagaaaattgtattttatgaaaatgtcgaacgaaaaaacggcacctccaaatggtcgttcagcagtctgtttaactacggaatggacggcgtcgtttcatttaaccataagccgctgagattatgtttttatacaggcattttcatcctgctgctttccatcatttatatcattgccacattcgttaaaattctgactaacggtatttctgtgcctgggtatttcaccattatctcagcagtgttatttctcggcggagtacagctgttaagccttggaattataggggaatatatcggccgaatctattatgaaacaaaaaaacgcccgcattatttgatcaaagaagcgaatatcccgaacaaagacctgcctgaaacgaacgaattaaaaagcatgcggcgtctgacaaaaatgcactgaaaataccaagcgccattggcagtgctttttttgcgtgtctattatcttaaaagcaagactggagaatttatatgaaaagaaaacatatcatgatctatgcggccagtttgctggtgtccgttctggcacacgctttttttgtgaaagaatgggcggaaggcaggtatatgacaggtccgggtgacgggcttgcgcaaatgatcgtatttaaaaaattattatttgaccaatatacacacgggaattttttctacaattattcattcggacttggcggcggcacattcagtcagctcggctattatttttctgcgtcttttctttttcttgctgtgtccgccgctgtttggctgcttcaagccgtccagctgatcggagaagcggatacgcttttttgggcagagtcagctgtttttatcagtattttcaaattgagcttgattatctttacgtccgcttctgtttttcattatcttctcaagcacagggcggcatcgttcacgggagctgtgttatacggcgtctcaattatttatttccgtcacgaagcgtattgggaatttttcaccgatacaatggtttggcttccgctgcttgtgcttggcgcagaaaaaattattagagagcggcgtccggcgtggtttatcgttgcgtgttcgctgacgttaatcaataatttttactttgcatacataaaccttatattcatcggaatctatgtgctgttcagatggctgatccgattggaaccacatgaagagaaaagatggattcaaatcagattatttctggtttcaggcttcatttcttttggcatcagtgcggcggcgtttgtgccggtggtatacggttttttaaacaacctgcgccctccatacagccagaaaatagagtggctcaatttcgatgataatatcttattttcgagccggatcatcattgtgccggccgcttttctgctgtttttgtttattatttctttttacaaaaaccgtgtgtttcgtctctttgccggattgagcctgctgtttattctttttcatttcagtccgtatgcggcaagcgtctttaacggtttttccgccccgcaaaaccggtttgaatatgttctggcctttaccattgcgggagcagctgcggctggtttgtcacagctgtctgatttgaaacggaaagaactgctcccggccgcagctgtcgtcctgcttctttacttgtatcatatccaaaggtataagctcgatatatggaagcctgcgaatgaaagtattctattgctcttactcatgacaatcgcagccttgtttgctgcagcttttgcgaaaaaacgggcaaacatggctgtgtacggcataatcattctttcttcgctgtttgtcgccaactcctatcaaaaatacgcgctctcagaaggcggcgatttggacagtgtgacaaaagaatatcttacaagtgaggaatacagagggcgggaatcatctgagctcattagacgtttacagaaggaagacgatgatccgctcatgagaatcgactggatgaacggggtccgcaataatacgccaatcatttacgggtttaatggcttcagcgcgtattccagcattttaaacaaagatctgctggccttctattggaatgatttaagcatcgatatgggcagggaaagcgtcagccgttacgcgtcattgggagacagggcgaatttatacagcctgctttacggcaaatattatatgaccgaaaaaacaaacgaagccagcgtcccgtacggcttcaaaaagcatttagaaacagagcattatgcagtttatgagaatcagtacatgcttccattcgtcaaaacagcggatgccatatacagcgaaagtgagctggaccgattgcccgctcttgcgaaagaacaggcgatgctgaaaggaattatattaaaagatccatcaggaaaaacggagcagacaccaaaaccgtccaatttgatcaccaagtcggacatcaccgcaaaacaagcccagtatcaaaaggggctgctaaccgtaactggagaaaacggaggagagctgatcatcaccccgaaacagccatcatccgctccgggagactactatgtcagcttttatttgaaaagcaaagcaaaagacaaaggatttacgttaaaggtaaatgattatgtcacaacaaggaaatcgaacaaatcgatatataaaaccggagtaaataatataacggtaagagtgcctaaatcacgccatatctcaatcaatcttccgaaaggaacctatgagctgagaaacatagcgctctatgaagaaaattaccaaacgctgaaaaacgctgtaatgcaaaataaaacagagaaagcagacaaactgaattggaacaaaaatcgactgacctttgcctatcatctgtcaaaagaccagtacatcatgcttccgatcccatatgaaaaaggctgggagctgaagatcaatggaaaaacacagaagatcgaaaaagcggattatgcttttataggcttcaaggcgcaaaagggagacaatcacattgagctgacttactatccgccatacttcaaaatatcggcgatcatatctctcgtcagtctgctgcttgctgttttttatataagacgtaaaaagcccggctctatatagagccgagctttaattttttctgtagtttttcttcgctgaatatccatcccgtataggatgaacgaattgtgagatcatggccgatatgaacaattgcgacaaacggataatggcctttgctccgataacgcaggtcgataaatctcacctcataatgatctttaaacgtatccacttcccaccggtaaaccggagaaaaggacagaaacgccgcgatgttatcatcctgctttgccgcatgcattacatcggtttcaggaacaggcacccgattaaatgtatccagaatcacgacatgtccttccatgcttcttcctacatagaaagcatgtgctgtcgtcactgcgattcgccattgcctgaatttcatcgttggagaaataataatgctttcgatctcatcatgaatcatctcatgaagcttccgtttaattctcagctgcatgatcaggcgcaccaagtaatagcctgccaatatgatatataagctgagaaacgtgatgccgggactcccgcctgcataccaaatcgcgatagctgctagatggctgataaaaataaacggatcaaacgtattaatcagcccgagcgcaacccattttttcgaaaacggacgaatggcttgtgttccataggcgttgaatatatcaacaaagacatgtagaacgactgccagcagtgtccacagccacaggtgcagaaaatcggcctgaggataaaataaatacagaatcgccgggatgatgacagaccaaaacaaaacggcgggaattgaatgggtaaatcctctgtgattccttatataaacagcattgtttttaagctttaacacagtatcaatatccggagcctgagagcccgcaagcgttgcgatcataacagcgtgagccattgccggatctgatccgacaacaggatcaagcgtcgcaataccgcccagtgcgatgcccataacgacatgtgtgcccgtatccataggtgacctccttgcaggatgatcctgcacattcactttgtaagaaattccccattttcatatacccaatttttaaactgattcaatcgttctcatatgtttccgctttttctttattactatttaatgtaacatattatcgtactgtgcccttagtgtacaacaaaaaacagtctaaagaaaagcggggcgcgaaagactggggagaaacacatatgaacgtacttgaagacaaattaaaacaaaaagacatacagcaatttcgcgatgatttaatctcatggtttgaacgagagcagcgcgttctgccgtggagagaggaccaagatccttataaggtatgggtatctgaagtgatgctgcagcaaacgagagtagagacagtgattccttactttctgcggtttgtggaacaattcccgacagtggaagcgctcgctgatgctgatgaagaaaaggtgctgaaagcatgggaagggctcggctattattcgcgagtcagaaacctgcaaagcgcggtaaaagaagtgaaacaggaatacggcggcattgtccctccagacgagaaagattttggcgggttaaaaggcgtcggcccttatacaaagggagcggtgctcagcattgcctacaataaacccattcccgcggttgacggaaatgtgatgcgtgtcatgtccagaattctttctatttgggatgatattgccaaaccaaaaacaagaacgatctttgaagacgccatacgagcttttatttccaaagaaaaaccatctgaatttaatcagggcttgatggagcttggagccttgatttgcacgccaaaatcaccctcatgcctgctatgcccggttcagcagcattgctcagcatttgaagaaggcactgaacgggagcttccggtaaaaagcaaaaagaaaaagcccgggatcaaaaccatggccgcgatcgtactgactgatgaagacggacaagtgtatatccacaaacggccgtctaaaggtttgctcgccaacctgtgggaattccctaatcttgaaacacaaaaagggatcaaaactgagcgtgaacagctcattgctttcttagaaaacgaatatggcatacaagctgatatcagtgatctgcaaggtgtagtcgagcatgttttcacccacctggtatggaatatttcagtgtttttcggtaaagtaaaacaagtgtcggataccagcgagctgaaaaaagtaacgaaagaagagctcgaacaatttgcgttcccggtgtcacatcaaaaaatctggaagatggcagtagaagcagccgccatctcggctgctccgtaaaccattcttaatcgtaagagacgcgcgtgccgtggctgtagtccgcttcattgcgcttcattccgccgcgcgcttcaatttcttgcgttaattcccggtattttgattggccttcttcgttcaaataaggcataatttgctgaaaggcatgatgaaaataagcgagttcactgttcttccaatcttttttggaaaccatgttcaattcgctcatatcacgtccgacatacataacagaagacccccctttaaagttcttgccattattgtttgtggaaataaaagaactatacgctacaaggagatgaggaaaaatggaacaaaataaatgtgcactcgtaacaggaagcagccgcggtgtcggaaaagcggccgcgatcagacttgctgagaacggctataacatcgtcattaactatgcacgcagcaaaaaagcagcattagaaacagcggaagaaatcgaaaagcttggcgttaaagtgcttgtcgtaaaagcaaacgtaggacagcctgcaaaaatcaaagaaatgtttcagcaaattgatgaaacgttcggcagacttgatgtttttgtcaataatgccgcttcaggagtactaagacctgtcatggaattagaagaaacacactgggactggacgatgaatattaatgcgaaagcattgcttttctgcgctcaggaagctgccaagctaatggagaagaacggaggcgggcatattgtcagcatcagttcattaggctctatccgctatcttgaaaactacaccacggtcggtgtatcaaaagcagcgttagaggctttaacccgttatcttgccgttgagctttcaccaaaacaaattatcgtcaatgctgtttcaggcggagcgatcgacacagatgcgctgaaacacttcccgaatagagaagatctgcttgaggatgcgcgccaaaacacgccggcgggacgcatggtcgaaattaaagacatggttgatactgttgagtttctagtgtcttccaaggctgacatgatccgcggacagacaattatcgttgacggcggacgctcactgctcgtttaaaaatttttaaaaaagaggaatagctatacgatcacctgcacattctaatgaccgtggaggtgataacaatggctaactcaaataacttcagcaaaacaaacgctcaacaagttagaaaacaaaaccaacaatcagctgctggtcaaggtcaatttggcactgaatttgctagcgaaacaaacgctcagcaagtcagaaaacaaaaccagcaatcagctggacaacaaggtcaattcggcactgaattcgctagtgaaactgacgcacagcaggtaagacagcaaaaccaatctgctgaacaaaacaaacaacaaaacagctaatcactgaaacagaaaaaagcacttcatcttcgggtggaagtgcttttttctgtttgaaaaacgacaaaacttgtggaaggtctacagaatgagtcaaagggtttgctttacggagatcgaaatgattaaaggaggaaatgtttatactttcatcaggctgaaggaggaaccgatgaccgaatttgaaaagctggtaagtgaacagatgaaaacgatggataagcttctcgatctccaatcagagctcgaccgctgcaaacaaattgaggcggaactccggcatttggaaagggatgcaaggctgcgtgggattcaggctgaaattgcggtaaaacggaaacaccttgccgatatacaggatatgtttcaaaagcagacagagcaggtcattcgttcttatcgcagctcagaaaagccgtcttcctttgtgtagtgcaggaatgtgccattccccggccggaatggctcttttattttcatttttcaatttgtaacgttataataggtaaaagacgttgtcggtaagcaaatttggacatactaactgtagggctttatagaaagtaggggagaaatatgggctatcccaaggaaggagaaaccattcaaattcacagctataagcacaacgggctgattcatagaatttggaatgagacaacaatcttaaaaagtacagaaatgtgtgtcatcggagccaatgaccggacgatggtaaccgaatcagacggccggacatggataaccagagagcccgcaatctgttattttcacgcaagacaatggtttaatgtcatcgggatgctgagggaagacggggttcattattattgcaacatcagttctccgtttgcctatgatggcgaagcaattaaatatattgattatgacttagatgttaaggtttttcctgacatgacctacaatattctcgatgaagacgaatatgatgatcatcggaaagccatgaattatccaaaagaaatcgacagtattttaagagactacttaaatacgctgctccattggattcaccagcgtcagggaccgtttgcgcccgagtttgtcgatatgtggtatgaacggtatctgcgctatacaaaataatggttacgtaaaaacctgttgcggggtacaacaggtttttcacatgggctcacacacatcatgagaaagagagagggggatcaacgtgggggttatgaaacgctatatgcaattcgtcaaaccttataagaagcaaattttcgttacagtgttaatcgggatcgtcaaattttccattccgcttgctctcccattgcttctgaagtacgtagttgacgacattattcaaggaggcggcacggccagtgacaaaaccacgtcattgttcacgattatggcgatcatgttcgccttatttttaattttgcgcccgcctgttgaatattaccggcaatattttgcccagtggactgccagcaaggtgctttatgatataagagctaagctgtttgaccatatacaaaaactgagccttcgtttttacgcgaacacaagaacaggagaagtcatttcccgagtgattaatgatgtagaacaaacaaaggatttcgtcatcacagggctgatgaatatatggctcgatatgctgacgattttgattgtaatctctatcatgctcacactggacgttaaattaacgctgatttctatcgtattattcccattatacggaatatcagtgaagtatttttacggccgtttacgaaagctgacaagggagcgctcacaggctcttgctcaagtgcaggggcatttgcacgaacgcattcaaggcatgcctgtcatcagaagctttgcgatagaagatcatgaacaggctcaatttaatgagaaaaacggtcatttcttagataaagccatccgacacacgaattggaacgccaaaacctttgcggtcgttaataccattacagatttggcgccgctcatcgtcatagcgtgcgccgggtattttgtcattaatggaccgctgacagtcggaacaatggtcgcgtttgtcggatatattgacagaatgtacaaccctgttagaaggctgatcaattcctctacaactttgacacagtcaatcgcatcaatggacagggtgtttgaatttattgacgagccctatgaactcactgacaaaccaaatgcgataaaggccgatcagattcgcggaggagtggagtttcaaaacgtttcgtttcaatatgagaaggacaaagaaaatattcttcatgatgtatccttaaaagtaaatagaggagaaactgtagctctcgtcggcatgagcggaggaggaaaatcaacgctcgtcagcctgatcccaagattttatgatgtaacaagcggcagactgctgattgatgggacggatattcgcgattatgaagcaagaagccttcgcaaccaggttggtatggtgcttcaggatacctttttatttagtgaaacgattcgggaaaatatcgcgatcggcaagcctgatgccacacttgaagagataatcgaagccgccaaggctgcaaatgcccatgaatttatcatgagttttccagaaggatatgagacccgagtgggagaacgaggcgttaagctttcaggcggacaaaagcagcggatctcaattgcgcgggtattcctgaaaaatccgccgctcctcattttagatgaagctacatcagctctggatttggaaagtgagcattacattcaagaagcgatggacaaactggcgaaggatagaacaacttttgttgtcgcccaccgtttatcgacaatcacccatgcggataagattgttgtcatggaaaacggcacaatcattgaaatcggaacccatgatgaactcatggactatgagagccagtacaagcatttatttaccattcaaaatttgaactaaaacatcaatcttatatccttttaacgaaggatataagatttttttgtgtataaaaaaacccggctgtttaaccgggttactcttctgtttctatttcgcagtctttcggatgatacgtttgaaaacttgtgataagtgtttccaaatgttcaagctgctcgcgatattccacggcgcttgccataatattgagcatgttgtaatcaataagctcctcatccgtattctgctgattttttaaaaatgactttgttaaaagctgcttatactggatgccttcttcaaccgcgtcatcatgcggcttgatttttccgacaaacctcatcaaaatccgttcgtgccagtaaagcaggtaatcaagttcttcagtcagtgtttcctgaaactcttccggcatatgatagatctcgttttccagacgatgcagcttcttcaatgtatcaagcgcccgatttgccgtaataatggcctgtctgaacaggacaagctttcttgatttcacataagtcgttttcttaaagtaacttctttcttctttatatagaagatatgtctgatcaagcttgatcattttttctttcagtttttcaatatcctctttcaaaatcgaatgctctgtcgactgccgcatggacaatctgatccacttcataatttcttcggtgttttcgacggtattatgaatcagctttgtttcgtacttaggaggcaaaaacacaaggttgacgataaaggaagaaagcacccctaagatgactgtgcttgttctgatcagcgcgaacattaaaaagtcgtcaccggcagattctaatatcgcaatgactgttacaagagcaattgaaattgtatgttcaattttaagtttcagcatgattgtaatgacaataactgctgttaacccgatcataatcgggctgggtccgaaaataaggccgaacactgtggcaatcacagctccgatgatatttgcttgaacctgatcaataataatgagaaaagagcggtaaatcgacggctggatcgcaaatatcgctgcaattccagcgaaaatcggcgcgggaagcccgatccacgaagccaaataaagggcaagtgtaatcgcaatcccggttttgaaaatgcgggcaccaagtttcattggtttgtgcgtgcattcctttctatagtaaattgtgtgacgtagcaaatgggctaatccttaaaattcccggttagtttatttgctaaacaattaagtaatatacagggatcgatacaaatattcaagctatttttctagaaaaagaccaaaatcttacacgttgtttgattccataaaaaaaacaggagctcaaagctcctgttcaaggtatttgattctagttttttagatgtttaaatgcatcctcgaccgctgcaagcgtgtctttaatatcctgctctgtatgtgctgtggtaataaaccaagcttcatacttagaaggtgctaaattaattccgcgttccagcatcagcttaaaaaacgtagcgaatgtttctccgtcactccgttcagcctgctcgtaattttccactttctcatcagagaaatataccgtgagcgcaccttttaaccggttgaccgtaatggtgatgccgtgtgtttctgcgtgcttcaaaatgccttcctcaagcatagcgccaaggtgatcaagcttttcatacacgccttcctctttaagcacttccagacaagcgatgcctgataggatggaagcggggttccctgccattgttcctgcttgataagcaggccctagcggagctacctgctccatgatttcttgtttgccgccataggcgccaatcggaagtccgccgccgataattttcccgagtgctgttaaatctggtttcacctgtaagagatcctgcgcgccgccatacataaagcggaaagccgtaatgacttcatcgtaaataacgagagcgcctgcattatgtgtcaattcatttactttttctaagaagccctctttcggctcgacgataccgaagttgccgacaatcggttcaacgagaactgccgcgatttcactgccccatttatcaagagccgctttatagctatcgatatcattaaatggtactgtgatcacttcgtttgcaatgcttttcggtacaccggctgagtctggtgtgccgagagtagacgggccggagcctgcggcgacaagcacaaggtccgaatgcccgtgatagcagcccgcaaatttaatgatttttgtccggcctgtatatgcgcgagccacgcggatggtcgtcataacggcttctgtacccgaattgacgaatcttactttgtccatagcgggaatggcttctttgagcatctttgcaaatgtaacctcgtgttttgttggtgttccatacagtacacctttctctgccgcttttttaatcgcttctgtaatatgcgggtgggcatgtcctgtaataatcggaccgtacgccgctaaataatcgatgtatttgttgccgtccacatcccaaaaataagcgccgcttgctctctccattgcaacaggagaaccgccgccgactgctttatatgatctagacgggctgtttacaccgccgacaatgtgctgtaatgcctcattgtgaagttcaattgattttgtatgcaagaataaaaacctcctatatctccatgcgtcctttctattgtagcatgcttccgaacaagaacaatggcttcgggcttcagattcagctgagatggttgtaatctggacaagaattggatacgcttaataaaaaacatccggaggtaacgtaatgactatagaaatcggacataaagcgcctgatcttgagttaaaaggtgatcatggggaaacagtaaaattatcggattataaaggaaagtacatcgtgctttatttttatccaaaggacatgacaccggggtgtacaactgaagcatgcgattttcgggacagtcacgaaagcttcgctgaactggatgccgtcattatcggcgtcagcccggacagccaggaaaaacacggaaaatttaaagagaagcataacctgccatttctgcttcttgttgatgacgagcatgagctggcggaagcatttgatgtgtggaagctgaagaaaaacttcggaaaagagtatatgggaatcgagcgttccacttttttaattgataaagaaggccggctcattaaagaatggagaaaagtaaaagtaaaggaccatgtagccgaagcgcttcaaaccctcaaagatatgtcggaaaagtaaatctctatgagcctatgcttacttttaccctgatatcaattgacaaattatcgtaggaagagttacactaattataaacattacaatgtaagaattttttttagaagagaggtgcatgacggatggctgcacatgaactaaaagaagccttagaaacgttgaaggaaaccggagttcgcattactcctcaacgtcatgcgattctggaatatctcgttaactctatggctcatccaacagcggacgatatatataaagctctggaagggaaatttcctaacatgagcgtagcgacagtatataacaatttgcgtgtgttccgggaatcaggtttggtaaaagagctcacatacggtgatgcttccagcagattcgattttgtgacatctgatcactatcacgcgatttgcgaaaactgcggtaaaattgtggacttccactacccgggccttgatgaagtggaacagctcgctgcccacgtcacgggcttcaaggtaagccaccaccgtttagaaatttacggcgtctgccaagagtgttcgaaaaaagaaaatcattaaaaataagctgaccgcacgaaacggtcagcttattttatttcgacattttctttttattataagactcatcaaattcttttccttctaatcccttatctaaagtcagcggctctcggcaatgcatgcacatatcgactcttcctaaaacctttgtctctttatcacagcctggacaaatgacgcgaaccgctttagtcgaaagcattccgatccaaaagtaaactaccgtgctgagaccgatggataaaagcccaagtatcataaacaaactagaaagcaaaactgactctttgaaaaagatcccgatgtacataatgataaacccaacgaaaaccaaacttaacgcaaatgttctgattttattaattttgctggagtatttcgccatgtccatccccctccgatttaactatagcacaaacccgatgggattttcttcatgttttcggttgaattggaatttacttatggagacttactgtgaaattgtttataatagttcaatgtgtttagaaaaaaggaatttcgttttaaccatagaattgaatcaaatagagaataaaaaaatttgaacaattgcattggaggaatagtgatggaaaatcttctccgtccaatttaccaagaaagagcaagtcaccccaatacattggctgtcattatgattgagagaagaaacaaaacatcttccttaacagataactttgatgcagctttgctggtgattgtaaaggatgctgatgagccagtttttataaagcattatgaatttgatcatcaaacagcttctttgcatgtggtaacagattctcagattcaagaatggattttgcttggaacaaatagaagaatcatagattggattgtaaatggcagagtcttgtttgaccgtaatgaatacgtagttgaactgattgacaggctgaatacatttccgtttgccgaacgtaaactgaagatcggactcgaatacggcaaattaatcagaaggtatgttgaagggaaagctttttttgaagccgatcaatttttagatgcctacaacgctgttgttcatgcgctgcatcatttagcacgtattgaagtaatcgacagaggattccatcccgaaaccacggtgtggagccaagtgcgccagatggagccgcaagtgtacaaattatattccgagctgattgaaagtcatgagagcctggaaaaaagacttgaattattattcttagcaaatgattttctcatccattccaaagccgagatcggttcggcgcatcttttcgaagtaatgaaagaaaaagacatttggcaattcggtgagcttcttcaacatcatgacctaaagcactttacccaagatcttggcgttatgcttgattacttgacagaaaagggacttatcaacgtctgccagatagaaacgaaaggacaggctgtctatcaccgaggatattcttttaaaaaaggtgttgactctgattcttgaccgtgttatattattaaacgtcgctgatgcgcttctgagaaaacaagctcacagcggcggggaaataaatcaaaaaaacatttgacaaaagaaagtcaaaatgttatattaataaagtcgcttcaacaagaagtgaaaatgatctttgaaaactaaacaagacaaaacgtacctgttaattcagttttaaaaaaatcgcacagcgatgtgcgtagtcagtcaaactagggcctgcacgacgcaggtcacacaggtgtcgccgcaggatgcggtgaacttaacctgtgatccatttatcggagagtttgatcctggctcaggacgaacgctggcggcgtgcctaatacatgcaagtcgagcggacagatgggagcttgctccctgatgttagcggcggacgggtgagtaacacgtgggtaacctgcctgtaagactgggataactccgggaaaccggggctaataccggatggttgtttgaaccgcatggttcaaacataaaaggtggcttcggctaccacttacagatggacccgcggcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtaccgttcgaatagggcggtaccttgacggtacctaaccagaaagccacggctaactatgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggacgtccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaaccttttaggagccagccgccgaaggtgggacagatgattggggtgaagtcgtaacaaggtagccgtatcggaaggtgcggctggatcacctcctttctaaggatattatacggaatataagaccttgggtcttataaacagaacgttccctgtcttgtttagttttgaaggatcattccttcgaaacgtgttctttgaaaactagataacagtagacatcacattcaattagtaatacaagatatcacatagtgattctttttaacggttaagttagaaagggcgcacggtggatgccttggcactaggagccgatgaaggacgggacgaacaccgatatgcttcggggagctgtaagcaagctttgatccggagatttccgaatggggaaacccaccactcgtaatggagtggtatccatatctgaattcataggatatgagaaggcagacccggggaactgaaacatctaagtacccggaggaagagaaagcaaatgcgattccctgagtagcggcgagcgaaacgggattagcccaaaccaagaggcttgcctcttggggttgtaggacactctttacggagttacaaaggaacgaggtagatgaagaggtctggaaaggcccgccataggaggtaacagccctgtagtcaaaacttcgttctctcctgagtggatcctgagtacggcggaacacgtgaaattccgtcggaatccgggaggaccatctcccaaggctaaatactccctagtgaccgatagtgaaccagtaccgtgagggaaaggtgaaaagcaccccggaaggggagtgaaagagatcctgaaaccgtgtgcctacaagtagtcagagcccgttaatgggtgatggcgtgccttttgtagaatgaaccggcgagttacgatcccgtgcaaggttaagcagaagatgcggagccgcagcgaaagcgagtctgaatagggcgcatgagtacgtggtcgtagacccgaaaccaggtgatctacccatgtccagggtgaagttcaggtaacactgaatggaggcccgaacccacgcacgttgaaaagtgcggggatgaggtgtgggtaggggtgaaatgccaatcgaacctggagatagctggttctctccgaaatagctttagggctagcctcaaggtaagagtcttggaggtagagcactgattggactaggggcccctaccgggttaccgaattcagtcaaactccgaatgccaatgacttatccttgggagtcagactgcgagtgataagatccgtagtcgaaagggaaacagcccagaccgccagctaaggtcccaaagtatacgttaagtggaaaaggatgtggagttgcttagacaaccaggatgttggcttagaagcagccaccatttaaagagtgcgtaatagctcactggtcgagtgactctgcgccgaaaatgtaccggggctaaacgtatcaccgaagctgcggactgttcttcgaacagtggtaggagagcgttctaagggctgtgaagccagaccggaaggactggtggagcgcttagaagtgagaatgccggtatgagtagcgaaagaggggtgagaatcccctccaccgaatgcctaaggtttcctgaggaaggctcgtccgctcagggttagtcgggacctaagccgaggccgaaaggcgtaggcgatggacaacaggttgatattcctgtaccacctcctcaccatttgagcaatggggggacgcaggaggatagggtaagcgcggtattggatatccgcgtccaagcagttaggctgggaaataggcaaatccgtttcccataaggctgagctgtgatggcgagcgaaatatagtagcgaagttcctgattccacactgccaagaaaagcctctagcgaggtgagaggtgcccgtaccgcaaaccgacacaggtaggcgaggagagaatcctaaggtgatcgagagaactctcgttaaggaactcggcaaaatgaccccgtaacttcgggagaaggggtgctctgttagggtgcaagcccgagagagccgcagtgaataggcccaggcgactgtttagcaaaaacacaggtctctgcgaagccgtaaggcgaagtataggggctgacgcctgcccggtgctggaaggttaagaggagcgcttagcgtaagcgaaggtgcgaattgaagccccagtaaacggcggccgtaactataacggtcctaaggtagcgaaattccttgtcgggtaagttccgacccgcacgaaaggcgcaacgatctgggcactgtctcaacgagagactcggtgaaattatagtacctgtgaagatgcaggttacccgcgacaggacggaaagaccccgtggagctttactgcagcctgatattgaatgttggtacagcttgtacaggataggtaggagccttggaaaccggagcgctagcttcggtggaggcatcggtgggatactaccctggctgtattgaccttctaacccgccgcccttatcgggcggggagacagtgtcaggtgggcagtttgactggggcggtcgcctcctaaaaggtaacggaggcgcccaaaggttccctcagaatggttggaaatcattcgcagagtgtaaaggcacaagggagcttgactgcgagacctacaagtcgagcagggacgaaagtcgggcttagtgatccggtggttccgcatggaagggccatcgctcaacggataaaagctaccccggggataacaggcttatctcccccaagagtccacatcgacggggaggtttggcacctcgatgtcggctcatcgcatcctggggctgtagtcggtcccaagggttgggctgttcgcccattaaagcggtacgcgagctgggttcagaacgtcgtgagacagttcggtccctatccgtcgcgggcgcaggaaatttgagaggagctgtccttagtacgagaggaccgggatggacgcaccgctggtgtaccagttgttctgccaagggcatcgctgggtagctatgtgcggacgggataagtgctgaaagcatctaagcatgaagccccctcaagatgagatttcccattccgcaaggaagtaagatccctgaaagatgatcaggttgataggtctgaggtggaagtgtggcgacacatggagctgacagatactaatcgatcgaggacttaaccatatttttgaatgatgtcacacctgttatctagttttgagagaataagtttttttcaaaaaaacacttgattttctcaagaatacatagtataatgttaaatgtcactgaaattgtctggtgatgatggcgaagaggtcacacccgttcccatgccgaacacggaagttaagctcttcagcgccgatggtagtcgggggtttccccctgtgagagtaggacatcgccaggcagacttcattccgcagtagctcagtggtagagctatcggctgttaaccgatcggtcgtaggttcgaatcctacctgcggagccattattggagagctgtccgagtggtcgaaggagcacgattggaaatcgtgtaggcggtcaactccgtctcaagggttcgaatcccttgctctccgccactgatacttatacataattacaattgaaagtctgggcccgttggtcaagcggttaagacaccgccctttcacggcggtaacacgggttcgaatcccgtacgggtcattatatgatggaggattagctcagctgggagagcatctgccttacaagcagagggtcggcggttcgagcccgtcatcctccaccattatatcatcgcggggtggagcagttcggtagctcgtcgggctcataacccgaaggtcgcaggttcaaatcctgcccccgcaaccaaattttaaaatggtccggtagttcagttggttagaatgcctgcctgtcacgcaggaggtcgcgggttcgagtcccgtccggaccgccatttaaatacttaggctcggtagctcagttggtagagcaacggactgaaaatccgtgtgtcggcggttcgattccgtcccgagccaccacctatgccggtgtagctcaattggtagagcaactgacttgtaatcagtaggttgggggttcaagtcctcttgccggcactgttttttcaaaatttaatgtggaggggtagcgaagtggctaaacgcggcggactgtaaatccgctccctcagggttcggcagttcgaatctgcccccctccaccatttataggggcatagtttaacggtagaacagaggtctccaaaacctccggtgtgggttcgattcctactgcccctgccaaatttatgacatcttgagattatggcggttgtggcgaagtggttaacgcaccagattgtggctctggcactcgtgggttcgattcccatcaatcgccccatattatcattgggctatagccaagcggtaaggcaacggactttgactccgtcatgcgttggttcgaatccagctagcccagtctcactttttatatcaactgcatataatgtattaagtccattaaaaatgcggaagtagttcagtggtagaacaccaccttgccaaggtgggggtcgcgggttcgaatcccgtcttccgctccaattacggcggcatagccaagtggtaaggcagaggtctgcaaaacctttatccccggttcgaatccgggtgtcgccttcttattgccggggtggtggaattggcagacacacaggacttaaaatcctgcggtaggtgactaccgtgccggttcaagtccggccctcggcaccaattttacttacatggtaagttgaattggtgtttgtgttttatcattataactaatcatattaatgatctacataagtagatcatttttttaatgctttgatttatcataacaagttaagttccgaggcctattataaagcggctgtatagctagtctttcaacacttttattttatatttccataaaaacttttttgaaatacgttgacactttatgagatccatgatatatttatattcgtcggttagatacgacgtaaaacttgccggtgtggcggaattggcagacgcgcacgactcaaaatcgtgttccttctggagtgtcggttcgaccccgaccaccggtatactgaaaaacccgtttcttaacagaaacgggtttttattttttattaaagaaaaggagcctcggctcctttttatacttactcagcgtattggtctaggatctcttctagcacctcttctagctcttctgtatcttcaagctctgattggctgaaacgtacgcgtacaagctgttctccgtcattatacatctcttccagccaccctcggagtcctcttgctctgcggtcgacttcgaaaatgatttccaaaccgtcttcgtctaaaaggaaaatgagctctaattcatcaagcatctgacgataatatccggaagtcggaacgaattcgaattcttgaacgaacggaagacgacgctggaagtagggcgcttgttcgcagtctgcttcgttaagatggaagcccaggttttcgattgcttcaagcacattttcaatccaagggtgcgcttcaacgaaaatgcggtcatgatcggatttatcgataccgccttgaatgtcaaggtctgtcaccacggcaacctctactttccctacagtgatcggcgtatctagaggcagagtgaatgtgaacggaaattgatgctcttcaccaggctgaatggtaaatgaaccagtgacccggaaagaatgaattgtagcgtatttccggtgctcttcatcgtcttttacaatgacataccgtgtactaagctgtaaatcgatataacggatgtcctgagcgatttttccgcctttgacatgtacagttccctgtacttcttctccaggaaaatatgcgtctttctctaaaatagtatcaacttttgctgctccaattccggcacttgccgcaagcttcttaaaaagtgacatgttagatcttcccctttttcttttttctcaacagatatacgtaagaaggaggaaaaaagattcattcgatccatacttttttcctattattcgtctcggcctagggacagactaagaataatattgaaaataaaggagtggatggaagtgaataaagaaagtttggttgcagatgaattacacagaatgtttttggctggtgagctgcaaatcacagtagaggaggatataaacaatatttccgaaaggctgagaaacggcgatctcagtttagaccgattaagcggtgaagacgcgtttataaaagaaacggtaaacgaggctttaagaagagtggagcaataaaaaagagacggtatctcatctttgagatcccgtctctttttgtgatctttgctgtaagataaaagcgtaattgctcaccagagccaccctttttccaacagaaaatctgacagttcatcttggagataaacagttgtatctaattgatcatgcaatgctcttctgatgtggggattttcggcttctgttattgcgacagtgtatttgttaatgctggtttttattgttgttaacaaatcaagaatatctttgggacaaagactttgttcaatgggaaaccacctcctttgtttttttagcagctcctgataagaaagtatttgactttgtttcttgcttctatacaaaatgctataataagcaacaaattttgttgggggtgtgatgatgaagcagattattgcgatggggggcgggggtttttcgatggagccggataatttgtccctcgatcaatatatcctcaatcaatcaaaacgagagcagcctcgtatttgttttttgccgacggcgagcggagattcccaaaactatattcagcggttttatcatgcatttcaaacactggattgtgtgccgtctcacttatctttgtttaagccgccatcaacagatgtagcttcttttgttatggaaatggacgtgatttatgttggcggtggaaatacgcggaatttacttgtgttatggaaagagtgggggctggatcatattctcagggaagcatggaagaacggtgtggttatagctggattaagtgccggtgcgatctgctggtttgaagaaggggtgacagattcagccggaccgctgacaagtttgaaaagtttaggttttttgcaagggagcttttgtccccattatgacggggaaaaggatcggagaccggcataccaccagctgatatctaacaagttcttatgcagtggctatgcagcggatgatggggctgctctccatttcataaatgatcagctgtttcagactgtgagttcaaggtcgggtgcaaaggcatatcgggtgatgatggctgaacatgaaatagctgaaatcccgttgccggtcaaatatttagggtgaaattggctgaatattatctatattcctctttttttcagattgattttatgataagatgagtgcgaaatcaatagttactgggggtgcccgctttcgggctgagagagaaggtaagcttcttaaccctttggacctgatctggttcgtaccagcgtggggaagtagaggaattgtttttgttattgtcgtgctgggcaataatatgtttctttctgactgtaaccgggttcatttatatgaatccggttttttgtgctggttatgggcttgattttgtcctttcaaacgtagagaggggaaggaaagtaatgcaaaacaattcagtgcagcaagccaacatttccattatgtcaagtttttcaggcagcaagaaggtatacgtggagggttcttcttcggacatccaagtgccgatgagggagatcctattgagtccgacgacgggatcgttcggcgaagaggaaaacgcgcctgtgcgtgtctatgatacaagcggaccgtatacggaccctgaagtaaccattaatattcaagaaggattaaagccgctccgccaaaaatggatcacagagcgcggtgacgtggaagagtatgaaggtcgggctataaaaccagaagataacggttataaaaaagcaaatccaaacgtaagctacctaggattaaagcggaaaccgctgagggcgaaggcaggtcaaaatgtcactcaaatgcactatgcaaaaaaggggatcattacacctgagatggaatttatcgccattcgtgagcatgtgtctcctgaattcgtcagagacgaggtagccagcggccgggcgattattccttcaaacattaatcaccctgaaagtgagccaatgattatcggccggaattttcatgtgaagattaatgcgaatatcgggaattcagcggttacgtcatccattgaagaagaagtggaaaaaatgacgtgggccatccgctggggagcagatacaatgatggatctctctaccggaaaagatattcatacgacgcgtgaatggattatccgcaattgccccgtgcctgtgggaactgttccgatttatcaggcgcttgaaaaagtaaacggcgtagcggaggatttaacgtgggagatttatcgtgatacgctaatcgagcaggcagagcagggagtggattattttacgattcacgcgggtgttttgcttaggtatgtaccgctgactgccaaacggacaactggtattgtgtcacgcggggagcgattatggcgcagtggtgtctggctcatcatcaagaaagctttttatacacacattttgaagaaatctgtgagattatgaaaacgtatgatattgctttctctcttggggatggtttgcgtcccggatcaattgctgatgccaatgacgaagcgcagtttgctgaattagagacgcttggagagctgacgcaaattgcctggaagcatgatgttcaggtgatgattgagggtcctggacatgttccgatgcataaaatcaaagagaacgtcgataaacaaatggacatttgtaaagaagcgcctttttacacattggggccgttgacaacggatattgccccgggatatgaccatattacttcagcgatcggagcggcgatgatcggttggtacgggacagcaatgctttgttatgtaacgccgaaggagcatttagggctgccaaaccgtgatgatgttcgtgaaggagtcattacatataagatcgctgcgcacgctgcggaccttgcaaaagggcatcccggagcgcaaatccgggatgatgcgttatcgaaagcccgttttgaattccgctggcgggatcagtttaatttatctcttgatccggagagagcccttgaataccatgatgaaaccctgcctgctgaaggagcaaaaaccgctcacttttgttccatgtgcggtccgaaattttgcagcatgagaatttcacaggatattcgggattatgcgaagaaaaacgatctcagtgaagcagaagccataaataaaggattaaaagaaaaagcaaaagagtttgtcgatacgggaagcaatttatatcaatgaaaaagatgaagatggagaatgctccatcttcatttttttagaaaaacagagagcgtcgaagcggcggaatgctctgttcaaaacggaaaacattttctggatcatatttcgttttgacacggcggaggcgttctacgttttcgccgtaatatgttcttggccagtttctgatttcaatatctggccaatttacgtagtctcccatcgtttctctcgaaagggacgttctcagcccctcaatccagcggacgttttgtcttttttctccaggggatgtccagtttgttaagtattcctgggcaatgattgcgtcacgataataaaatgccgtttggtcgggagcgatccgtccggctgccccgccgagtgcttgctgccagacactggcgttttgattcggagcgtgctctaaaaagtgttttattgttgaaatcgcacgttctgataatggcttttcaatgaaagagccggagcgtttcattttttgaggctgattgcctcccgggctgttaaaaaaggttaccgcttcgatgaacggcattgtttttaccattccgcttgttgggcttcctgctttcaataaaggctttaacagtttttttaactctgtttttggcccgacaaattggccgagggcttctatgcggtttacttctttagggcaaaactctattgatgatgtaagccggtcatctgtatacggggcccagtgctgccacgtgttaaatacttcctcaaaatcatcccatccccatgttatagaaaaaatcgacacttgagagatgggcactgctttaaatgtcatggaggtgactatgccgaaattgcctcctccgcctccctgagacgcccaaaataagtctggatgatttgaacagctgactgtaatcagatcagcgccctctttttcgtctgctacgatcatcttaagctgcacgaggctgtcgcaagtaaggccggcagcccttgttaaaagtccaattccccctccgagagttaaacctgtgagccctacattagcaatggtgcctgcgggaagcgtcaggccgtattgccagagtgtccgatagacttctcccaattcagcccccgcttcaatataggccagctttttatcctgattcacagttatttttttcatctcgcttaaatcaataacaagaccgttatttaaaagggaaaagttctcatagctgtgtctgccgcctctaatacggaaaggcacacggttttcacgcgcccatttcagcgcattgagtgcatcctgtttgttttggcaaaacacaatgatgtcaggatacctttctaagcttaggttaatattggttcttgcttcgttatagtccggatcatcccgtgtcacgatacgtccggtcaattttgtcttttccacactcccacatctctttctctcgtattctagtttctctagcttatgcgtcaggggaaaagagtgtataaggaaaaagcggggatgcaatctgatacagtgtcaacaccctcaaaaaatagttgacaggtcggtattgtatgaattaacatggtcagtacaaatttttcaaattaatcgcgctgatcggaacaccgaaggctcttatcgtttagataagggccttttttgtatgaaaaaggagggattattgatgggagtcaaaaaagaaaaggggagaaaacgattcaggaagcgaaaaacctacgggaatcagattttgccgcttgagctgctgattgaaaaaaacaaacgagagattataaacagcgcggagctcatggaagaaatttatatgaagattgatgagaagcatacgcaatgtgtaactaaatataaaaaaacccgctgattacagcgggtttttgcatttctacattaagcatcttttttaatcggcaatccaaggccttctgccacgcgttttccgtattcaggatccgctttgtagaagtgctcgatttgacgaagcttgatttcttctttttctaccggcttcatagcattaacgatattttcaacaaggcgggtacgttcatcttcactcattaaacgatacagatcaccggcttgagtgtagtgatcgttgtgatcgtagcttacgctgtcagcgataccttgtaccggatatgctgcttgcttatcctcaggtgactcttttggaccgccgaagctgttaggctcgtaatacacagatccgccgccgttatcgtcaaaacgcatttgtccatcacgctgataattgtttactttgttgcgtgcgcggttgattggcagcgcttgatggtttgcaccgacacggtagcggtgtgcatcatgataagcaaacagtcggccttgaagcattttatccggtgaaacatcaataccaggcacgagtgttccaggtgaaaatgtcgcttgttctacctctgcaaagtagttttccggatttctgtctagaaccatgcgtccgacctcgattaacgggtagtctttttgagaccaaacttttgtgacatcaaacggatcgaaacggtacgtgtttgcatcttctaaaggcatgatttgcacatatagtttccatgcaggataatcaccgttttcgattgcattgaaaaggtcttctgtatggtaatcagggttttcaccagcaatttttgctgccgtattgacatcaaggttttttacgccttgttccgttttaaagtgatatttaatccatacgccttcgccttcggcatttgtccatttgaatgtatggcttccgaagccgtgcatgtggcgaagtgttgcaggaattccgcggtcagacatcaggattgtcacttggtgaagtgactctggtgaaagtgaccagaaatcccatacagccgtagggtttttcaggtgtgtttttggatctcttttttgtgtatggatgaaatcagggaacttaatcgcatcgcggataaagaatacaggcgtattgttgccgacgatgtcgtagtttccttcttcagtataaaatttaacagcaaatccgcgcgggtcgcgaactgtgtcagcagagccaagttcaccggcaactgttgagaaacggatgaacaacggtgtgcgtttgccgacttcagaaaggaaagcggctttcgtgtattttgttacgtcgtttgtcacttcaaaatatccgtgtgcgcctgctcctttggcgtgaacaacacgttcaggaacacgttctcggttgaaatgggccaatttttcgagtagatgtacatcttgaattaaagttggtccgcgagaaccggcagtcattgagttttgattatctccaaccggagcgccccagctagttgtcagtttatttgaactcatgttatcacctcttggaatttataagaacataatatcatctctaagtaaaaagtcaatattattttataattattataaaatagttatatctattaatcgatatctaatatcgaaagtgttgaaaaaccttgttgtaacagctttttatgacacttaataatttttggagaaataattttttcttctctatttgcgaaacaagcagagtaagtgataaacaaggatatcaaaaatcgtatttaaaaaagagttgacatatcggaataatttgaattaacatgttattcaaacaaaaaaacaattgggcagctgatcggaccgccgaaggctctcatctctacaagaacagagatgggggcctttttgttttttttgaaggcggggttggcagaaagagagggataaaagtggctgtgaccatcagcatcaaagaaaaggcatttgttcaagagggccgcaaaaacacggtcttagagaacatagaattatcaatcgcaccaggcgaatttctaacgcttatcggaccgagcgggtgcggaaaaagcaccctgttaaagattattgcagggcttgattctgaatatgacgggagtgttgaaattaacggccgcagcgtaacagctccgggtattcagcaaggatttatttttcaggaacaccgcctctttccttggctgactgttgagcagaatattgccgccgacttgaatttgaaggacccaaaagtcaaacaaaaggtgaatgaactgatcgagattgtcagattgaaaggatcggaaaaagcatatccgcgcgagctgtcaggcggcatgtcacaaagagtagccatcgcccgggcccttctgcgggagcctgaggtgctgcttttagatgaaccgtttggtgcactcgacgcttttacaagaaaacacctgcaggacgtgctgctggatatatggaggaggaaaaaaacaacgatgattctcgtgactcatgatatagatgaatctgtttatttaggaaatgagctagcgatccttaaggccaaaccggggaaaatccataagctgatgcccattcacctggcgtatccgcggaaccggacgactccggatttccaagcgatcagacagagagtgctgtcggaattcgagaaaacagaagatttggagtacgcagaaggatcagggatatagaaagggcggaagcggaaatgaaaaaagggctcattgtattggttgctgttatttttctgctcgcaggctgtggagcaaatggagccagcggtgaccacaaacaattgaaggaaattcgtattggtattcagcaaagcttaagcccgcttttgatcgcaaaagaaaaaggctggtttgaagatgcatttgaaaaagaaggcatcaaagtgaaatgggtggagtttcaaagcggtccgccccaatttgaaggccttgcggcagacaaacttgatttttctcaagtcggtaattcgcctgtgattgctggacaggcggcaggcattgactttaaagaaatcggtttgtctcaggacggtttgaaagcaaacggcatccttgtcaatcaaaacagcagcattcaagacgttaaggacttaaagggaaagaaaattgcagtcgccaaaggcagcagcgggtttgattttttgtataaagcgcttgatcaagtggggttgtcagctaacgatgtgacaattattcagcttcagcctgatgaagcagcttccgcattcgaaaacggatccgttgatgcctggtccatttgggagccgtacttgtccttagaaacaatgaaacacggagcaaaaatccttgtgaacggagaaagcacagatttatattcaccgggttttactttagtaagaacaaagttttcagaagagcatccagacgaagtggtccgttttctgaaggtgtttaataaagccgttgtatggcaaaaggaacatctggatgaagcagcggacttgtattctgacattaaagatctcgataaaaaggtcgtcgaaaatgtgctgaaaaatactgaacctctgaatgaggtcatcagtgacgacattgtgaaagcgcagcaggaaacagcagattttcaatttcgaacaaaggcgatagataagaagattgatgtgaaggatgttgtcgataacacttttatcaaaaaagcattaaaggaacattcctcaggaggtgatcaatgatgaaagcagaggctgcgggctcgctgcccaaaacgaatgcggaagcggtgcgaaaaaagcccggaaggaagagatacggctggatgaaggggcttttactgcccgctgtcatcattgccatctggcaggtcatcggcgggctgggggttgtgtccgctacagtgctgcctacacctgttacgattgttctgacctttaaggagcttattttgtccggcgaactgttcggccatctgcaaatcagcatttatcgggcggcacttggttttttgcttggcgcggggcttggattgatgatcgggattttggccggattctccaaacggacggagctgtatcttgatccgtcgttgcaaatgcttagaaccgtacctcatctggccgtcacgccgctgtttattttatggttcggatttgacgaagtatctaaaattttgctgattgcgctcggtgccttctttcctgtctatatcaatacgtttaacggcatccgcggggttgacgcgaagctgtttgaagtcgcccgggtgcttgaatttaaatggcatcagcagatatccaaagtgatattgccggcagccctgcccaatatattgctaggcattcgcttatcgctcggcattgcatggctcgggctcgttgtggcagagctgatgggctcaagctcgggagtcggctatatgatcatggatgcgagacagttttcacaaacgaataaagtctttgcagggattatcatttttgcagtggttggaaagctgacggattccttcgtcaggctgcttgaacgaaagctgttaaagtggagaaacagctacgaaggataaaagatataaaggggagatgaatatggaaattctttggtttataccgactcatggagacgcgagatatttaggatctgaaagtgatggacggactgcggatcatctttactttaaacaagtcgcgcaggcggcagacaggctgggatatacaggagttcttctgccgacgggaagatcgtgcgaggacccgtggcttacagcgtcggcgctggcaggagaaacaaaggacttaaagtttttagttgcggtaagacctggtttaatgcagccttctctggcagccagaatgacatcaaccctagaccgcatttcagacggccggctgctgatcaatgttgtggcagggggcgatccgtatgagctggcaggcgatggcctgtttatcagccatgatgagcgctatgaagcaacagacgaatttttaaccgtttggcggagacttttgcagggagaaacggtttcctatgaaggaaagcatataaaagtggaaaacagcaatctgcttttcccgccgcagcaagagccgcatccgcccatctatttcggtggttcgtcacaggctgggattgaagctgccgcaaagcatacagacgtatacttgacatggggtgagccgcctgaacaagtaaaagaaaagatagagagagtcaaaaagcaagcggcaaaagaagggagatccgttcgatttggtattaggctgcatgtcattgcccgtgaaactgaacaagaggcgtgggaagcggcagagcgcttgatcagccacttggatgatgacaccattgccaaagcgcaggcagctttgagccgttacgactcttcaggccagcagcggatggccgtccttcatcaaggcgatcggacgaaacttgaaatcagcccgaatctgtgggcggggatcggcctggtcagaggaggggcaggaacagctcttgtcggtgatccgcagacgattgccgaccggatagcggagtaccaggcactcggcatagaatcgtttatattctccggctatccgcatttagaagaagcgtattattttgcagagcttgtatttccgcttttgccgtttgaaaatgatcggacgagaaagcttcagaacaaaaggggagaagcggtaggaaacacttattttgtcaaagagaaaaatgcatgagtttaattaaaatacagcccccaaacatggtatgatattcaaaaaaagggggctttttttctgaaaacattgagaagcgcggcagtcatttgcctcatagctatgctgtcagcatgcggacattcaaaacagatggaaatcaaagcggcggacatatcagaacttgaaaaaaacagaatggatgttgcagcttcacaggcattcactgctgaagccgtcaatatcggtgaaggtatttcttcagctgacatgtacatcgaacattatcaaaagggaaagcttgttgagaggttaggaccggctagtgcagattattcagaggaaaaacccgataccatacaatttgtttattttgagaatgaagagggggcaggaaagaataaacataccaccattcattttggcattgtggataaacagggaactatagcggctgattcatcggtgaaacgtgacgatagcacaacacaggaaatgactcagaatatttcatcgccggaaccgattactttcgagaagcctgctttgatcggcagcagtattagagggactgacgagacaatgcacacctctgaacataaaaaagagctcattaagcatcaagatgcgttactgtattatgtggaattgcatcattagaatgggcggcttcaggccgtctgtttttcaaagcggtatgcttgcttttttgaatggtgcatgatacattttaaatcgtaataatttcgatttaaaagggaggctatgtgacttggctaaaaaatcaaaagtggcaaaagagttaaaacgccaacagcttgttgaacaatacgctgatattagacgcgagttgaaggaaaaaggagattacgaggcactcagcaagctgccaagagattcagcaccgggaaggcttcacaaccgctgcatggtaacggggcgcccgagagcatatatgaggaagtttaaaatgtccagaatcgctttcagggagctggcccataaaggccagattcccggtgtgaaaaaagcaagctggtaagaaaaaactccggccgattacagcgcgccggagtttttttcgtttttcttgaaagagatgacgtaggaaaggtgctggatgatcatgatgataaacacaataataatagggaaaaacggaatacgcgattgaaatagtggataaaaaatgagaagaaccgctgcggcaggcagcgagaagtagacagcgatatatgacgcgcgacatgcttttgccgtcatcatctgctctctttcatcctgctcttcaaactcatcaggcagaagaagctgctttctggcagggcggctttttttctgtaagtacaaataaaccgcaaacgccgcaacaaacagaataaagggggtgaggtttaattcaaataccatcccgccgctctttgtgccgaaaaaagatgctatgccttctgaggcttcaaagtatgaaatcagcgtccagcatgcaaggccaaataacacaaggtgaaaagctgcttttgttttcatgctcatcttagttttcctcctctaaccaaaagacatcctccattttcatggagaaggctttgcagattttcagtgctaacagcagtgagggaacataatcgcctttttcaatcgctgccacagtctgtcttgtgacgccgaccgtttctccgagtttttcctgagaatagccgaagcgtgccctcagctcttttactttatttttcatcatgacgtctgtccccttcacaatctcgattgattatattgtatagtatacttaacattatgtaaatgaaacttaacaactttacaaaaagacaactttttttcgacaaattttttatattcccttgacgaaaaataaataaacatgtaatataaaaaaagtcagagcggtactgttactgacaaccacaaatgcgggtgtagtttagtggtaaaacctcagccttccaagctgatgtcgtgagttcgattctcatcacccgctccatacatacgttattaacgcagtgtttcgtttctcagataaacgaagtattgcgtttttttatgtaaaaaagaacacgacattcgtgttcttttacgtaagccaatgtactgtatgggtgccgccgtgaatttgttcaaacattttcgttaatgatgataagaggttaacagcgctgcttttctcaatagatggcgggaaaaaaatgatttgcagcatattcttagtctcgtttgaaacgggatagtggttgacgctgtttttgaaatcgccaaaaatgccgttttcatcagagaaaagcagtatgttttctttttctcccaatgagatccggaccggctcatgaagctttccggcatcataaatcataataggcagagaatattttaatgcgaaaaaatcgattgtgtcatgggccgagtctttactttccatgaattgttccttggatatcgggaccagcatgtcctccattggggttgtttctccctcaaatgaagggttaagctgtttaaagagtttctgccattccttgacgaaggattcatcggatataccgccgtccgcatagtcgaaaaacaaggattcttgaaacaggcggagtctgcctttcagcatttgcggtgaggagccgacttcgatattctcataaatgacagcagctgcatgtaagccggccacacgttcagtaataacagaatcaagtttgatattcactagcattcactccagttacgtgatatcaacctattataaacgctgtatcgttttatcacaaagaaaggaggctgtgcaaaacatgaacgtttatcagctcaaagaagaattaattgaatacgcgaaaagcattggcgtggacaagattggttttacgaccgctgatacttttgacagtttaaaagaccgtttgattcttcaagaatcactcggctatctctccggctttgaagagccggatatcgaaaaaagggtgacgccgaagcttcttttgccgaaagcgaaatcaatagtggcaattgctctcgcatatccttccagaatgaaggatgcgccgagaagcacgagaactgagcgcaggggcattttttgcagagcttcctggggaaaagactatcatgatgtgctgagggaaaagcttgatctgctggaggattttctaaaaagcaagcatgaggatatcagaacgaagtcaatggttgatacaggtgaattgtctgatcgcgccgttgcggaacgtgccggaatcggattcagtgcgaaaaactgtatgatcacaacacccgagtatggctcttatgtgtatttggcggaaatgatcacaaatatcccttttgagcctgatgtgccgattgaagatatgtgcgggtcctgcacgaaatgtttggacgcctgtccgacgggagcactggttaatcccgggcagcttaatgcgcagcgctgcatctcttttctgacccagacaaaaggatttttgcctgatgaattccggacaaaaatcggaaaccgcctgtacgggtgcgatacgtgccaaacggtatgccctctcaataaagggaaggattttcatcttcatccggaaatggagcctgatcctgagattgccaaaccgttattgaagccgcttttggccatcagcaatcgggaatttaaggagaaattcgggcatgtctcaggttcttggcgcggaaaaaaaccgattcagcgaaacgccattctcgcgcttgcccattttaaggatgcttccgcactgcctgaattgacggaactgatgcacaaggatccgcgtcctgtcatcagggggacagccgcatgggcaatcggaaaaatcggagaccccgcatacgcggaagagcttgaaaaagcgctggaaaaagagaaggatgaagaggcaaagctggaaattgaaaaaggaattgatttgctaaaagcttcaggcatgactaaacaaggcctgtcctgacatacgtatagagcagaaggaaaaaacacttgagatcatccaagtgttttttctctataaaaaagtatggcgggtggggtgagcttgaagcacattttagaacaattagcggaggagcggctgggctttctggttaacgggcatgctatgagacaggagtctcaagtcggagaccttaaagtcatggagcgtaagaaaaagcttctggaaaaacgtaaagttgacatcataaaagcgaaagcaaaggccgtgattaatcatgtgcgggttgaggatgacggaacgacctgcctttcgtataccatccattacgaatacgtgtgtaaggaacaagatgacagcttgtatatagaagagcacatagaggagcgaatggctttcctgtatgatcacattttgattagtgatcaggaaattgcgaaaaagccggctggatttcatgaagggaccagtattattgactattctgaagctgaagaggaaagagaagcgtttggcagggcttttcaatacgatcgtctcggcgctgtccaatatgccgagaaattttggaacaagcgcaatcctgcttataaaaatttcagcgataactgtacaaattttatttctcagtgtcttcatgcaggaggcgcgccgatgcgcggtcacccgaacaggggatcaggctggtggatgaaacaaagctcatggagctacagctggacggtggctcactctatgaaaatgtatttgtcgaattcaaaggccggactgcgtgcggtgcgggtgaaatcagcggaagaactgatgccgggcgatgtgatttgctatgacttcgaaggagacggccggtttaatcatacaacgattgtcgtgacaaaggacaaaggcaatatgccgcttgtcaacgcccagacttatgacagcaggatgaggtattggtcatatgaggattctacggcatacacgccgtcaatacgatatgccttttttcatatcgttgatgatacgacaaaagagtaattaatgttataatgatgggcggataagaaaaacagaggtgaacattgtggcattacatgtcgttttatatcaaccagaaattcccgctaacacagggaatattgcacgtacttgtgcagcaaccaatacaacgctacacctgattcgtccgctcggcttttcaacggatgataaaatgctgaaacgtgccggactcgattattgggagtttgttaacgttgtgtatcatgattcgttagaagaattgtttgaggcatataaaaaaggcaagtttttctttattacaaaatttggccagcagcctcatacatcatttgattacactgatcttgacgaggattatttcttcgtgttcggaagagaaacaagcggtttgccaaaggatttaattcaaaataatatggaccgctgcctgcgtcttccgatgacagagcacgtcagatcgttaaatctgtccaatactgccgcgattcttgtttatgaagcgctgcgccagcaaaattaccgtgatttaaaatagtgaaaaaacccgctcatcgatgatgggcgggtttttttgcggatgttgaaatgctttgtttcgtttttgggcttaacaacgtaacagtgttatgttacaatgtacccatcaaaggagctggacttatggaagaacaattaatctctaaaaaagaattacttgaaagaacatcgatttcatacggtcagctgtatcgatggaagcggaaaaacttaatacctgaggaatggtttattcgtaaatccacatttacagggcaagagacgttttttccgagagaggagattttaaaacgtatatcaatgattcaaaagatgaaagaaaatttgtctttggatgaaatgagggaaatgctgtcgccgaaaatgaaggatgtcagcatgaccgctgatgaattgcttcataaaggtttggtttcaaggcctgctcttgaagcctattcagaagacggaggaagtccggttttctcatccagcgatttgctttcgctgtatgtgcttgagggactgctgcagtctggaaatgtcagccttgcagaagcaaaaatggctgcagaggtattaaagaagcatgatactgaagagattgaaaaacagacggagctgattgtgctccgcaagctcggtgtcacaacttgttttatagcggctgcggcggacagcattttgtttgaatcatccgtaaaggttgtggaacgggtagatttattaaaagcttcagaggaattaaaaacaacatttatgcaggagggccatcgatggatgtagtggaaaagctggtgataaacggatcaggaagttcaaagggaggaacatttcaatctgttgagattaatggcagcgggacagtggccggggacgtggagtgtgacactttttcttttaatggaaacggaaaagcggacggcagcgtcaaagcgaaagcggtaaccatcagcggttcaggaaagatacatggagacgttgaagcagaatctatccggatgaatggcactagttttatccaaggagaggtatctgcaaaacaattgaaaatcgctggatcatcaacatttggcggcactgtcaaggctgatggcattgacattagcggaaaagctgtcatggaagcagattgtgaaacagaaacctttcaatcagaagggaaatgcaaaatcagcgggcttttaaatgcagaccaggtgatcattaagctttctgcaggggaaagctatgcgcgggagatcggctgccgccatcttcaagtgacctgcagaaaaggaatgctgacattgctcagattgatgccgcagcctgttctaacagcagagctgatcgaaggtgacgtgattgaattgacaaatacaaaggcgaaaaccgtgcgcggtaataaagtggtcatcggcccggattgccagattgaaactgtcgaatacagcggggactatacctgtgatccaagcgcatcggttgaaacatccacaaagttgtaaggaggatcgtaatggagacaacaaaactgggaaatttaaaattatatggcgctgggcatgccacaggaggcgcgtatcacaatgtcagcatcaaaggagaaggtgtagttggagaagggttgtctgctgtaggctgccgcatatacggaacgggcctttttcttggaaaagcagagactgagcggctgcgtgtgcttggagaaagtgaatgtaaaggcgatctgacagccggcaaaatcaatatatatgggacaatgaaagtcagcggctcacttcaatttgatcgattcaatctgaaaggccagactgaaattggcgggaatatgactggagaatcctgcgatgtgaaagggaagctcagcgtaaaaggtgattgtgaaacagaaatgttccatgtcacaggctgtgttgatgtatcggggttattaaattcgggtgagatcaagctgggattgagccatgatataagtcatgtacaggaaatcggcggaacaacaattacagtgaaaagacgcgcgagtttttttaaccggaagaaagtgaagctgttcgccgatgtcatagaaggagatcggatttatttggagaataccgaagcggcagttgtcaggggaaaagaagtgatcatcgggccgggatgcagtatcggaacaattgagtacgaaaacaaatatgaatgcgatccgcattcacagattaaagaaaaaacaaaactgtaaaacattgttctgttatacaaaaagggtgctctttcaggagcacccttttttattcttttccaggcttgctttcgtatcctgcggtaaaaattgatactaaaaaagtgacaatgacacccatcatgatgattgttttcaccgtctctccccctcttcaatttttccgtgctgtccgagtctggatgattctgtatttttctttattatgaacggtcgcagtctgccttgtcaacgatgtataagtatctttatttttaagaaaccaaagcatgtatcacgagatggcggcatagattgtatcaaagtaccttatttgcatagtgtatcaaacatgatagaggaggtccttatggatatattaaagaaaattgaaaagtacagagaggaagagcagcggctgaaatgggaaggaactttcgccgattatttggagattattaaagaaaatccgatggtcgcgcaatctgctcattctcgagtttttaatatgataaaagacagcgggatagaggagattgacggacgcaagaagtacagtttttttgaccgcgagctgttcgggcttgaagaatctctggagcgtcttgtggaagagtattttcatccggctgccaaacgtctagatgtcagaaagcggattctattgctgatggggcctgtgagcggcggtaaatccacgctggtcacaatgcttaaaaaaggtctcgaagcatacacgctgacagataatggcgctgtatatgcaattaaaggctgcccgatgcacgaggaccctctacatttaatcccccatcatttacgcgatgacttttacagagaatacggcattagaatagaaggaagtctttctcctttaaatgtcatgaggctggaggaagagtacggaggaagaattgaggatgtgaaggtggagcgcatcttcttttcagaagataagcgtacgggaattggaacattcagtccctctgatccgaaatctcaggatatcgccgatttgacggggagtattgatttctcaacaatcgccgagtacggttcagaatcagatccgcgcgcttatcggtttgacggagagctgaataaagcgaaccgcgggatgatggagtttcaggagatgctgaaatgtgatgagaaatttctctggcatttgctttccttgacacaggaagggaattttaaagctgggcggtttgcgttaatttctgctgatgagctgatcgtggctcacacgaatgaaacggagtatcgctcatttatttctaataagaagaatgaagccctgcactcaagaatcatcgtgatgccggttccttataatttaaaagtgtctgaggaagagagaatttatgaaaaaatgattgcagaaagcgatgtggcggatgttcatattgccccgcatacgttgaaggtcgccgcgatgttctcaatccttacccggttaaaagagccgaagcggtcggatattgatctggtcaagaaaatgagactgtatgatggagaaagtgtggaaggatataattctgtcgacgttgaggatatgaaaaaagaatataatgatgaaggcatgagcggcattgatccgcggtacgtgatcaaccggatttcttcaacgattatcagaaaaaatatggaatcgattaattctctcgatgtccttcgctccttaaaagaaggtcttgatcagcacccatcaatttcaagcgaggacagagagcggtatttgaattttatttctgccgcccgcaaggaatatgacgatattgcgaaaaaggaagttcaaaaagcgtttgtgtattcatatgaagaatcagcaaaaacacttatggacaattacctcgataacgtagaggcctattgcaataaaaacaagcttcgtgatcctttgacaggagaggaaatgaaccctgacgaaaagctgatgagatccatcgaagagcagatcggcatttcggaaaacgccaaaaaagcgttccgcgaagaaattttaatccgcatctcggcctatgcgagaaaaggcaagcggtttgattacaattcccatgaaagactgcgtgaagctattcagaaaaagctgtttgctgatctgaaggatgtcgttaaaattacgacctctacaaaaacgccggatgaacagcagctgaaaaaggtaaatgaagtcgtggcccgtttaattgatgagcacggctacaactcgacgagcgccaatgagctgctgaaatatgtcggcagcctgctgaaccgataagcaacgtgacccgtccgaatagggcgggttattttgtcccattttctaaatagtttgtcaattaaacgtgcatatgtgcatatgatgaatataaatcttttcaaaagacttgtttcataatctggcacaagccggaatacgtatgtatcacgaccacaaatggttaaggaggggaattcatgtcccaaaatgacagcggccattttttgatttctgaggaaaactggtccctccatcgcaaaggcttcgatgaccagcagcgccaccagaaaaaagtgcaggaagcgatcaaaaacaatcttccggacctcgtaactgaggaaagcattattatgtctaatggaaaagatgtagtgaagatcccaatccgttcacttgatgagtataaaatccgttataactatgataaaaataaacatgtagggcaaggagacggcgagagccaggttggagatgttgtggcccgggatggatcagacaaaaaacaagggcctggaaaagggcagggtgccggtgatcaggcaggcgaggattattatgaagcggaagtttcattaatggatttagaagaagcgctttttaaagaattagagcttccgaatctccagcaaaaagagcgagacaatatcattcatacagatatcgagtttaatgatatccgtaaaacagggttaaccggtaatattgataagaaaagaacgatgatgtcagcctttaaacgaaacgcaatgtcaggaaaaccgtcgttctatccaatttatccggaggacctgaaatataagacgtggaatgacatcacaaagcccgaatcaaaagccgtcgttttagccatgatggatacaagcggcagtatgggggtttgggaaaaatacatggccagaagcttctttttctggatgacccgttttttgcggacaaaatacgagactgtggaaattgaatttattgcccatcatacagaagcaagagtggtctcggaggaggattttttctcaaagggagaaagcggcggaacaatttgttcttccgtatatcggaagtcgcttgagcttattgatgaaaagtacaatcccgcccgctataacatttacccgtttcatttttctgacggtgacaacctgacatctgataacgcgcgctgtgtgaagctggtcaatgatattatgaagaaggccaatctgttttgctacggcgaggtcaatcagtacaacaggcattcaacgttaatgtctgcatataaaaatgtaaaagatgagaaatttaagtactatattttaaaacagaaatctgatgtttttcaggctctaaagaactttttcagaaatgaagagtctggtgtaagccatcaattttcgtaatgaaaagcccatttcagggcttttttttatttaataaaagcaagaaaacgcttgcgaaaaaaatacgggagaaaaagaaatttttcctttgacaaatcttctttcatttattaatattttatcttgtgaactattattgaggaatgaggtgaaaaggagttgactgaatcagaacgtgctttgctcacttttgaacagctcttcgatacgtctcgggcgatatataaaaaacagaagaagatattggagattgtgcttgagccttttgatattacagtccttcaatatttgctgatgtttaaaattcatcaaagcggaagcaccccgctaagcaagctggcaatgtcgcttgatcttaagcctgcttctgtgacgcggatgacagatattctgtataagcgccaattgatgaatcgatatgacagtccggatgaccgccgtatcgtcatgattcagttaaccgaagagggggaagaactgatagaaaaagccgctgtgcaatatgcaaaaatgggtgctggcttgtaccaaaagcttgatacctcccagctgcagtatttgcgcaaactagccggaagcttaacgaagcttgctgaaggctgttcagaaaaaagcggtaattaaaaacttctcacatattttcaccagctttccgcaaaatgatagaggatgaaacgaaaggagaaaacaaaatgaacagaggacgtttaattctgaccaacattatcggtttgattgttgttcttgcaattatagctggaggtgcttactactattatcaaagcacaaactacgtaaaaacagatgaagcaaaagtagcgggcgatatggctgctattactgctccagcagcaggtaaagtatctgactgggatctggacgaaggaaaaacagtgaaaaaaggcgacacagttgcaaaaatcaaaggcgaacaaactgttgacgtaaaatccattatggatggaacaattgtgaaaaacgaagtgaaaaacggacaaaccgtacaagctggtacaacaattgcacaaacgattgacatggacaacctatacatcacagcaaatattaaagaaacagatattgcggatattgaagtaggaaatagtgtagacgtagtagttgacggagaccctgatactacatttgacggtactgtagaagaaattggttatgcgactaactcaacttttgatatgcttccttctacaaattcaagcggaaactacacaaaagtaacacaaaaagttcctgtgaaaatttcaatcaaaaacccatctgataaggtgcttcctggaatgaatgcatctgttaaaatttctgagtaaaacagatcagtcatcaaaccatgaaaggaggttgtcttagatggctacaggcaaagaaaaaaatgcaaaaaaccctatgtcattgctgattgtgctaatggcgggtttatttttggcaattctaaaccaaacactgcttaatgttgcaatgccgcacttaatgactgaatttggcgtaagtgcaacgacgattcagtggctgacaacaggttacatgcttgttaacggtgtattgattccgttatctgctttcctgattacacgatttggccagcggagtctctttctcgtcgcgatgttttgttttacgctcggtacgttagtctgcggtatcgcacctaacttctctacaatgctgatcggccgtttgattcaggccgtgggcggaggtatcttgcagccgctcgttatgacaaccattctgttaattttcccgcctgaaagcaggggaaaggaatggggattttcgggctagcgatgatgtttgctccagcggtcggcccgactctttccgggtggattattgagcattatacatggcgcattatgttttacggacttgtgccgatcggcgcaattgttatcattgtggctttcttcatctttaaaaatatggtggagccgcaaaaaatcaaactcgatactcttggcgcaatcctctcgattgtcggattcgcctccttattatacggagtcagtgaagccggatctgacggctggaccgacccgattgtattgtctacagttattatcggagccattgcaattgttgcttttgttgttcagcaattgcgtcatgatgatccgatgcttgatttcagagtgtttaaatatgacattttctcactctcgagtgtcattaatatcattattacagtggcactttacactggtatgttccttttaccgatctatctgcaaaacctggtcggctttacggcgcttcaatccggtctgcttctgcttccgggtgcgatcgttatgctgattatgtcaccgatctcaggtattttgttcgataaattcggaccgagaccgcttgcgattatcgggcttctcgtgacagtggtaacaacctatcaatacacgcaattgacaattgatacaccatatacacacatcatgctgatctattcaattcgtgcatttggtatgtctctcttaatgatgccagtcatgacagccgggatgaaccagctacctgcccgtctgaacagccacggaacggcgatgagcaacacgcttcgccaaatcagcggatcaatcggaacaagtttaattacgacgatttatacaaaccggacgacattccattattcacaaattgcagataaaacaagcacggcggacccgaacttcctccatgcgttccaaaatgcagtttcgaatttaatggtgaatatgaatgtgtcttatgatacggcgaaaacatatgtgtactcacatatttataaacacgcgtcactcgattccaatgtcatggggataaatgatgcctttatgtgggcaaccttattctgtgtagcaggtttgattttaagtatcttcctgcgtgacgtcagaaaagataaattgcgtaagaagaaaaaagaggagctttcattacttcctgctccaaaagaagctaaggaatcttaatctgtacagggaggtttcctgaatgaaaatttatgtagtgtatgatagtgaaggcgaacatactaaagtgcttgcagaagcaattgctgaaggcgcgcgagaaaacgacgcggctgaagtgttcatcgaccatgtagatcaggctgatatccgcaagcttaaagatatggatgcgattatttggggatgcccagggcatttcggaacaatcagctccggtcttaaaacttggatcgacagacttggctacttgtgggctgaaggcgagctgatcaacaaagtcggtgctgtcttctgcacaacggcaacaacacacggcggcttggaaatgacaatgcacaatttaatcacgccgatgttccaccaaggcatgatcgttgtcggactgcctggcaacgtgcctgaaaacgcactttatggctcttattacggagcaggtgtcacttgtccggtagacagtgatgagttaatgtctgaggaaggtattcagcttggacgcgcgttgggaagacgtgtcagccaagtcacaggaaacctaacagcaggacagtaaggagaggttgaaatggccattattatagcaattattgctgctgtcattgtcattgcggcccttattacatttaatgtccgcagcgcctcacctggacctgagaagcaagacgcaactgatagaatcgcacctccagaagaggaaaaaaacgaagcgcattaccctgctgaagcaagggctgcggagcatacgccatccgttgtcaaaaacgattccccaaaagagaagcgtgacacaatgggtgatgatatttacaggcaggcgctgcaaaagtttaagcattctgatgaagttcatgcagaagaagaggtcactgaggaaagtgacaaaatgcaggaccgcagctatcgtgatgcgctgctctctatgaaaaataagaaaaagtaatgaaaaaggcaaatccgttttctcatgcgggtttgccttttttgctgtttccatcaattcggtttttatcaaataaatccatggaatatgttgtattccatcttgatctagtgtactatgttactcatacaccgagggttttttccgggaggtaaagacatgaattcttttttaggtttattaaagaaagatatcaagctttcaagaatgtggctgctagtatggatatgcggaatcattttcttattgggaacaggccatattatagcttctcgcacgaaagaacctctagtcatttttggtttttttgttgcagttgctttttttctgcttttcttatctcctgtttttgtgttttatcaccttcgcaaggaagggaaatcacagctttggctgtacaatccaaatggcggcttatggctgttttcttctaaattggcagcatctttgctctatcaatttgtgattcagttggcattaacagcctatggcatatggatgtatcatatgctctctgtaaaaaatctgctggagcatcaagttgatataacgagtacagtggctttgctgaatatgtatgggcttatttcttcgttagatatgtcagtaacagtcattgtgttttggactgtttttcactctctcagaaattggcgcagaatgcggtgggctgcgatggttctgttggttgcagtgtggttattcttcgatgaatacatcataagccctttggttgaatctcaaaagcatttctggcctgtaacagtctattgcaattttgattttcacttctacaatgtttggatattggaattaaaacctatccatctgtctgtgctagggtttcctattactttagtcatcacattcttgctgctcatcatggcttcaaaactgcttgatcgtaaagtagaggtgtaaatatgaacaatcaattccaatcctcgaaaccgatttatctgcagatcgctgatcagatcttttataggctggtcaggaaggagctgctcccaggagacaagcttccttcagtaagagaaatggcgattcaaactaaggtaaatcccaatacaattcaaagaacttacagtgagatggaaaggctgggtattgtggagacaagaagaggtcaagggacgtttattgcggaaaaagcagaaatcgtagacgagctgaaagacaagctgacacgagaggtgctggaaggctttgtcaagcaaatgaaagagctggggctaacgaaagaggaaatggtagaagggattaaaacattcacagagggaggctaaaatggaaatcaagctagaacatgtatcaaaaaaatacggccgccatacggccgtcaatgatgtgtcaatcaccctatcatccggacggatttatggcctgatcggaccgaacggcagcggcaagtcaacgaccctgaaaatgatggctggccttctgtttccgacttcaggatttgtgaaagttgatgaagagcaggttacgagagaaatggtgcgtcaaacggcttatcttactgagcttgatatgttttatccgcatttcactgttaaagatatggtgaatttttatcagtcgcagtttcctgattttcaaacagaacaggcttataagctattgaatgagatgcagctgaatccggaaaaaaagatcaaaaagctatcaaaaggaaatcggggccggctgaaaatcgttcttgctttagtgagacgggcagacgtcatcttgcttgatgaacctttttccgggcttgatccgatggtcagggattccatcgtaaacagccttgtgtcgtacattgattttgagcagcagattgtcgtgatcgcgacacatgaaattgatgaaattgagactttgttagatgaagtaatcatcctcgccaatggagaaaaagttgcgcagcgtgaagtagaagatattcgtgaacaggaaggcatgtctgttttgcaatggtttaaatcaaaaatggaagtttgctagaaagaggaggaatatgatgaaaacagtgttggaattgaaaaacgtgactaaaaacatcagaggccgaacgatcattgatgatctcagttttacgattcgtgaaggcgaggtattcggttttttgggaccaaacggagcggggaaaacgacaaccatccggatgatggtggggttaatgaaactgtcgaaaggtgatgtcctcatttgcggccaatcaattacgaaagaatatgccaaggcgattaagcatattggagcgatcgttgagaatcccgagctgtataaatttttgagcggatataaaaatctccagcaatacgcaaggatggtcaagggtgtcacgaaggaaaaaattgatgaagttgttgagctggtcggtttaacagacagaatccacgacaaggtgaaaacatattctctagggatgagacagcgtcttggcttggcacaatgccttctgcacgatccgaaagtgctgattttggatgaaccgacaaacggccttgatccggcggggatcagagaaatcagagatcatttaaagaagctgacccgagaaagaggaatggctgtcatcgtttcaagccacctgctgtcagaaatggaactgatgtgtgatcgaattgcgattctgcaaaaaggaaagctgatcgatattcaaaatgtaaaagatgaaaacattgatgagaatgatacatatttcttccaggttgagcagccgagtgaagccgctgctgttttaaatcagtacgatttgctgagtaagacaaatggtgtagaaatcaaactggctaaagaggaagtccctgcggttattgaattgctggtgatgcagcaaatccgtatttatgaggtcaaggtcataacaaaatcattagaggaccgtttcttagaaatgacaggtgaaacaaaagaggaggttcagcatgcttaatttgatttataatgagtggctcaaaattttcagccgagccggaacatgggtgatgatcggaattctggggctgacaatggttggatttgcatttttggcgaatcatttttctgctggtgaatcaaattcccattggaaacaagaacttcaagcacaaaacgccgaattaaagaaagaaatcaaagaagatccttcactgaaagatgggtataaagaaacaatcacactcaacgactatcgcatcgagcataatatccctagtgacacgggctatacggtatggtcttatgtaacggattcagcaaactttaccatccttaccggtctgtttactattatcatcgcggccggaattgtcgcgaacgaatttaattggggaacgattaagctattaatgattcggccgctcagccgttttcaaattttgatgtccaaatatattacagttctcctgtttgggctcctgttgctgttgattttatttatcggttctactttattagggttgatcttcttcggaacgggtggtgaaaccgccgcgaatattcatttaatctataaggatggccatgtcattgagcaaaacatgatggggcatttggccacaacgtatctttctgaatccgtctcggctttaatggtggcgacgatggcgtttatgctgtctgcggtattcagaaacagctctcttgcggttggtttttccatcttcttgttggttgccggtacgactgcaactgcatttattgcagcgaaatttgactgggcaaagtatatattgtttgctaatgtcgacttgactcagtatgtggatggcacaccgttaataaaagggatgactatgacgttttctctcgtcatgctggcgatctactttatcatcttcctgttgcttgctttcggaatcttcatgaagcgggatattgcaaactaataaataaagctgttttgcttatgcaaaacagcttttttgtcaaaataaaaactgcaggtttgcacctgcagtttttcatatcaatttatgcttacgcttctttagtaacgttagcagcttgtggtccgcggtttccttcaacgatttcaaaagaaacagcttggccttcttctaaagttttgaagccttcgccttgaatagcagagaaatgaacgaatacatcgtcttgaccttctacttcgatgaatccgaaacctttttcagagttgaaccattttactttaccttctaacatgaaatttcctcctaaagcgatcataacgcttaaattcactattcttgctcttaacaaactttcaagacgaaaactcttacaaaactttcttcttaaagatagttcgaacaaaaataattacctttactctaccagtaatcttcagaaaaaacaactgcttattgaaacttttttcggaaaataccatatttatttttcaatttgatatttatttgcggaaattcatctgctttctcgatatgtgatcatacgtttgccttagtatttcttcattttgggaagataagtaataggaattgacaaccttattggatatgagtaaggtaaaagttaatcaatattacaaatgacaacgtttatcaactaagagagcgtatgatttttatgtctgatattgcttgcatgctctaatacatagataggagtatggtcacaatgaaaaagtggcttatatgcagttttgtccttgttcttctcgtttcatttactgcatgttcaccgtctgcagaacatgaatcgataaaaatcgggattgctgagtctgacggggcaatatggaactatattgctcaaaaggctgaagaggcagggctggatattcagctgatccctttttctgattatgcggagtctgatatcgcacttgctaacaaagaaattgatgccaacgcctttcaaaccatttcatattttcagtcgttcactcaaaaatacaaacttaatttggcaccgctcggaacgacatacataacgcccatgggcatttattcaaaacgatatgaccgaatccgagatataccgcgaggagctgtcgtttctgttccggataaagcgttcgattttggcagggcgcttacggtgctccaggaagcgggtttgctaacgctgaaaaacggatttaacggaacaggttcagttgatatgattaaagataatccgagacacctgaaattaaaagctgtccggcaacaggatgcagtaagcggtgccgacgtgtttgtcatgaaaccatcagaagcaaaaaaagcgggcctgaacccgaaaaagcatacgctaaagagcggcggacccatgtctggggaagagatgaatttgattgttgttagagcggaggatcaagatcgggaagcgctgcaaaccattcttgagctttatcaagctgatgatacagcggcatttatagaaaaagaataccagggagatcttgtcccggcttttctgcctttgaaacgtctttcagattggaagaatgaattcgaacattgaattcattcttttttttctgaaaaacatactctgttccgtcccgtttctttcgctttgtaaagcatttgatcggcaagaatgggcaaggatcctggctgttccgtattattggggtaatgagcggccctagtgatatcgtaactgaaagctcttcaccgtttgttaatacaatcggtgcatcacttacagttctcctgatccgttcagcgatccgggctgctttatcaagagaacagttcggcaggagcacggcaaattcttcaccgccgatacgagcggcaggatcagtatttcggatgctctgcttcagacgtaaccccaactctttgagcacctgatctccttcatgatggccatattggtcattgatggtcttaaaatgatcgatatccatataaatcagtgcaaattgaaaatgcggggtatcggccgcctgctgatacagagcttttgtggtttcttcaaattttcttcggttatacacgcctgttaaaaagtcaaagtgcgcctgaaacttatattgtttaaaaagaagatgtgcatttgtttcatgatcaataatatataaactgagcatgccgcccgctattgatatgatccaaaaatacaaatgaagttcgtatgaatgtaaatctataagaaaataaaaggaaaaggagatcaagctatttgtgattattaaaagatagaaagcatgttttagttgaactttttttcttctagaaacaatgagtgacggaatggcagcgatacaaatgataataaccgagtatagtgcagatgtgttcatcgtaatcagcaagcggcctgcagtgatcatggccagggccgttgccgttgaaacccagcctccataaagagcggcaatcataatagggatatttcgaagatcaataattgaatgctgataggtaaatccaaaaaccatcagaataaccccgagcaaaccgcaggccagtcctttaacagcttgaaaagatatgctgtcttttttatgtactagcctttctttaaacaggtgggtgaagagataattaaatgtgattaaaatggtcaaatttacaaacagttctttcagcaaatattatcacccttatataaggtactaaagatggaagggaaagaaaagaacaaaaaaggcattatataaggtttttttacttgaattgataagttaaaataattcgcacttgacccatcggaattagtgtaatatagtaaatgagaaaatttgaagggagagtttacctgctttggagactttactggttgtattacatgtatttattttatttttacttatcttagggctctttgttatgcagaaaaaacatgtttccttctctaaacgtgtatttactgcgctggggctggggattgtattcggatttgcgcttcagctgatttacggcccgacttcaaatatagtcattcaaacagccgactggtttaatatcgccggggcggatatgtcaaattgcttcagatggttgtcatgccgctcgtctttatttcgattctcggtgcatttacaaaactgaagctgacaaaaaatcttgggaaaatcagcggtttgattatcgggattttagtagcaacaacagcagttgctgcagctgtcggtatcgcgtccgcgctttcatttgatctgcaggcgattcaggttgaccaaggaagtacagagctttcacggggacaggagcttcagcagaaatcagaggatatgacagcgaaaacgctgccgcagcagattgttgaactgctgcctggaaacccgtttttagattttacgggagctagaccgacttcaacgatcgctgtcgttatttttgccgctttccttggagtggcattcctcggcgtaaaacacaaacagccggaacaggcagaaacatttaaaaaactggttgatgccgtttatgccattgtcatgcgtgttgtcacactcattttgagactgacgccttatggggtgctagccatcatgacaaaaacaattgcaacgagtgatcttgacagcattctaaaactgggcatgttcgtgattgcatcatatgccgcgttaatcactatgtttatcattcatttgctgctgctgacgttcagcggcttgaatccggtgatttatttgaaaaaagcggtgcctgtacttgtatttgcatttacgtcaaggtctagcgcaggtgctttaccgctgaatattaaaacacagagaagcatgggtgtaccggagggaatcgcaaactttgccggttcgttcggtctttcgatcggccaaaatggatgtgccggcatttatcctgcgatgctggcgatgatgattgctccgactgtcggccaaaatccatttgacccggtgtttattatcactgttatcgcagtcgttgccatcagctccttcggggttgccggagtcggcggcggagcgacattcgcggcgcttcttgttttatcatcattaaacatgcctgtcgcgctcgccggtttgttaatctcaattgaaccgttaatcgacatggggcgtactgctttgaatgtcagcggaagcatgacatccggtcttattacaagtaaggtcacaaaagaaattgatcaaggggcatttcatgatcaatccagagtgattgaagctgaagaagcgtaacatatgaaaacgtgtaatccaagaggattacacgtttttttaacggccaggctctaagtcctccagcatttccatcatcgtgttgtcgtccatgacattcattgcgctttgttcaaaatgaatgggttcagcataatgcggctgtctttttttcgcggctgtctcagtttgcctagtttgagactgtgtatgctggtgctgtgtttgctgctgtccggcgtgctggtgctgacggccattttgccgctggctttgatgttgcgaacggtcttggttatccccgctgcctccgccaaatgcttgtttgactatgtttcctacattagaagcatcaaatgtgttattttctgaatttcttctgttcatttgtcctgtgataaacccgctgattctttggcggatctgaggtgataatgcagcaataagcatagttgatcctatgatcaatgctgcggggctgattcctcttcgctggttaaacaacatgatccctcctttgtagtgtattcatattttccccctcgttagacaaattaaccgttatatttcccgggaaagcatttcctccagatttgcatgcataattaaacccagttagaaaaacctataagtaaagtgataaaggaggaattcacatgtttggaaaaaaacaagtccttgcgtctatgcttcttatccctttgcttatgactggctgcggtatggccgaccaaggtgagggcagacgtgataataatgatgtaagaaacgtaaattatcgaaatccggccaatgacgatatgcggaatgtaaacaatcgggataacgttgacaacaatgttaatgataatgtcaataacaatcgtgtaaatgacgataataacaacgaccgaaaacttgaggttgctgatgaagcagctgataaagtaacagacctaaaagaagtaaagcatgccgatatcattgtggctggaaatcaagcctacgttgcagtcgttttaaccaatggaaataaaggtgcagtagaaaacaatctgaagaaaaaaatagccaaaaaggtaagatctactgacaaaaacattgataatgtttacgtttcagctaaccctgattttgtagagcgtatgcaaggatatggaaagcgtattcaaaatggtgacccaatcgccggattatttgatgaatttacacaaactgtacagcgtgtattccctaacgctgaataaatgaaagaagccgcacaatttgtgcggctttttctttgcgttaatgacacactgcgaactcaggctgcatagagtaaaaataaaaaggtacaagacggaccggctcagggagggagacgtttgcgggatggcataggaaagcgtgcggcatccgctctattcctgtgcggagtccttgtgatgctggctgtaagctcagccatcgtatcaagcgcgatgtatatcctgtcttttccaggtcaggcatctggaataacaaaagaacaagtgacgaagcacatgaagaaagagtcattcaaacaggccgatatttattacacttctaaggaaaagtccttactgccattgacgaaagaaacgcttgaatatgcggtcagtattaatcagattatgattggatattcgaatcaaaagcctattgacattattttttttcctaatgaaaaacagatggaggcttactccggtttattggatgtagttggtttttattctgaacgggagcagctgatcggattgttgcctgaagagaaaaagaaactgttagaaggggacgaggtagcagtttatttgtaccagagattgttgattcatgaatactcgcaccatgcgtttcaccagaaattgaaggagcttgagacggatcccgatgagtttccgttatggtttcatgaagggttaagcgagtggattgcgaactatgaattgctcatagatccgatcacgttttctgtcgtgccctttgaccgtttgcagactgatcgagactggcaggaagctagagccgaatatgacactgatgtctatttgcaaagcttttatatgatcgatgagctgacggacaaatacgggaaagacattatttcagaaatgattaaggaaacggcaaaaaaaggggactttgaaaaagggtttaaatcagcaacaaaggaaagtcttgatcaatttgaaaaagattttaagaaaaaatttgaaaaaaacagtgcggcattggatagtatctatccaatgcctttgttattagtgaagtccttgctgacccattccgccttgtgtcggaggcatttgtccttgggcaggggcgaatgaatttcgcagctgttccatatcctgcgcatcaagctgaggaacctggtaatagccgtgtttgttttggtataggaaaatttcaaatgccatttcaacatactcctgaatttgcgcagacagtacgcgtcttacggccggatttgtcatttccagagaagccatcgtcagcatagaagcttgtgctttaatcgcgcaaagcatttgtcggctgatgatgctgtcatcaatatcattcatggattgaacaggttttttaggctgtgacggctgcatgccgtaaacagtctggttgtcttccttcatcatataagttgctgttttttgtgaaggttcgcttcctgttttgaagcattctgcagttatattgtattgagatgtgatgaattgatgttgacgatcaaggatgtttagtaattcttgatccttacagaattgtctcagcatcataaactgatcaagcacagtaagtgttccggaaagcacctcatgcatatcaaacatttcatgtccgccgtggtttttatgcggtttgccaggaatacctttgttcatttgggattgctgctgctgattgaactgatccaaaccgaattcctccttttttttcagatcagctgtattttgtgtcagtctgccgtgtattatgcagaagcctgaaaggaattatatgctgtctgtcgaaatgataagcagacaaaatcgttgtcattatgtgtataagggaggaaatatgatgaggcgtattctgcatattgtgttgatcacggcattaatgttcttaaatgtaatgtacacgttcgaagctgtaaaggcagctgaaccgcaacagcctatatcgattgagaaggcaatacagcaaaaagaaggacaggcgcttgtcgaaggatatgcagtcggccaggctgtttccccgcagcattataagctgacaagccctttttcaaatgattataatgttgcgctggcagaccgtaaaaacgaaacatcgcccgaacacatccttcctgtgcaaatcccctccgccttcagaagccaatttgggctgcaaaccaatccgcttcttctagggaaaaagataacggttcaaggaaagcttgaaaattactttaacacgacaggacttaaaaacgttcagtcgatgaacgtaaccgatgacacaaaaactccgccggctgaacagcaagtgaccataaatgaagcacggggaaggctgaatgaagaagtaacgataaaagggatcattacagctgatcaaaacgcaatcggaggcgggaagctgtcgacctttttgcaagatgaaaccggaggcattaacatttattcgccatcccctgaacaatttcccgaattaaaagagggtatggatgtcacggtgacagggaaaatcacgtcttaccaggggctgaaagaaatcgttccaaactcatcaggcatcaaaatcaaccagtcaaatcaatccctccccgcccccaaacacttaacaatcaatgaacttattaacggcagcctaggtgatcagtatgaaggacgccttgtgaaactaaccgcttttgtttcctcaattccaagttctcctgccggcggcggttacaatgtaacaatgattgatgacgaccatcatgcaatgacgctccgggttatgaatgaaacaggggtgataaacgagcttgatgagggcaaatggtatgaatttaccggtgtgttaagcagataccaaacctttcagctgcttccgcgaaaatcggctgacctgaagctgcttgaagagcagcccgcacctccgtctgcagagggagaatatgaagggattgttgaccgggtagttgacggcgataccattcatcttaaatctccggtgcttggaacgacaaaaatccggtttgtaaatgtagatacacccgaaacatatcacacaccaaaaaatgacgcagatgaaaatcaattaagatttggcaaaaaagcatctgactatctaaaaacggttctgtccccgggtgataaaattactgtcaaggtcgggagtgaagccaaggacagctatggcagattgctcggacaagtcataaccgaatcaggttcaaacgtgaacttagagcttgtaaaaaacggctatgctccgacgtattttatttggccggttgacaatgaagaggattatcagcagtttcaggccgcagtagccgctgcaaaaaaagaccaaaaaggaatttggaatgaaaacgatccgctcatggaaatgccgtttgaattcagagccagagagcaagggaaaggcctgacaagatatgtggggactcgtcgaataaaacatatgtgcagccagctcactggaagaaggtagctgtggaaaacagaattttcttcgcttcagcaagtgaagcggagagcgcgggatataaaaaaacgcaaacggcacctaaagaacatgtgccgcttagaattctcagcatgaatgatttgcatggcaaaatcgatcagcaatatgagcttgatcttgatggaaatggaactgcagacggcacgtttggacgcatggattatgccgccgcatatttaaaagaaaaaaaggctgaaaagaaaaactcgctgattgtgcacgcgggagatatgatcggcggaagctctccagtttcctctcttcttcaggatgaaccgactgtagaactgatggaggacatcggatttgatgtcggaaccgtgggaaaccacgaatttgatgaaggcacggatgaactgctgaggatcttaaacggcggtgatcatccgaaaggcacaagcggatataatggacagaatttccccctagtatgtgccaattgtaaaatgaaatcaactggagagccctttttgccggcttacgacatcattaatgtggagggcgtacccgttgcttttatcggagttgtcacacagtcggcagctggcatggttatgcctgaagggataaagaatatcgagtttacagatgaagtgacagcggtgaatgaggcggccaaagagctcaagaaaaaaggcgtgaaggccatcgtagttctcgcacatatgtcagctgaacaaaacagcaacgccattaccggtgagtctgctgatcttgcaaacaaaacagattctgaaattgacgtgatttttgccgcgcataatcataaggtagttaacggcgaagtgaatggaaaactgattgttcaagcgtatgaatatggaaaagcgataggtgtcgttgatgtagagatcgataaaacaacaaaagatattgtcaaaaagtccgcggaaatcgtatatgtggatcaaagtaaaatccaacctgatgccagcgcttcagccattttaaagaaatacgaagctattgctgaaccgattatcagcgaggtagtcggcgaagccgctgttgatatggaaggggggtattcaaatgacggcgatacacctcttggaaacctgattgcggatggtatgagagctgccatgaaaacggatttcgcccttatgaatggcggcggcatacgtgaagcgctgaagaagggctcgattacgtggggagatctttacaatattcagccgtttggaaatgtgttaacgaagcttgagattaaaggaaaagatttaagagagattatcaatgctcaaatctcgccggtttttgggcctgactacagcatcagcgggtttacgtatacgtgggataaagaaaccggaaaagcagttgatatgaaaatggcagatggcaccgagatccagcccgatgccacatatacattgaccgtcaacaactttatggcgacggcgacaggagccaaatatcagccaatcggactgctgggaaaaaatccggtgacagggcctgaggatttggaagcgacagttgagtacgtgaagagttttgatgagccaattgcgtatacaaaagagggaagaattaagcttgctgaagtcagtgatattgaagaccctgtaacagaagacccgattacggaagagcctggagatgatccggggacggaggatccgattaaagaggatccaaggccagatgaagatttgcctgatataaaagaaactccgggaacagcaccggttcatcagcttccgccttcagccatttcgagattcaatgaaataccaatcaacaacacaaaaaccgctgatactgctaatagcatcagcacattgccgttacaaaccgaggctgcggaaagcgggtctgatcatcagcttccggatacgtcagcgggctactataactttatggtaatcggtgcggcggtgacattgtcaggaacttatctatatgtcagaagaaaaaggagcgcctccagaacgtgaaaaaagttattccactattcatcattgctgccggcctagtgatcgcaggctatggaggctttaaattgatcgatacgaatatgaaaacggaacagacattaaaagaagcaaaacttgcggctgaaaagccgcaggaacctttggggacgaaaaatagcacagatcaagcaaagaacaaagcatcatttaagcctgagaccggccaagcgagcggaattttggaaataccgaaaatcaatgcagagcttccgatcgtggagggcaccgatgctaatgatttagaaaaaggtgtcgggcattacaaggacagctattatcctgatgaaaacgggcaaattgtgctgtcggggcatcgggataccgtgtttcgccggacgggagagctggaaaagggggatcagctccgtcttctcctgtcatatggagaattcacatatgaaattgtaaaaacaaaaattgtcgataaggatgacacatctattatcacgctccagcatgaaaaggaggagcttattctaacgacctgctatccgttttcatacgtcggaaatgccccgaaacgctatattatatatggaaaacgagtgacttaaaaagccgaggcagtgcctgcggcttttcttcatgaaaaatatgtgcggcaaaggttttccatatcagcagggaaaggggcttcagcaactatgagctcgtctgttatcgggtgaaccgcttgtactttattggcgtgcagtgcctgcctgtttagcagcttgctcccgcctccgtaaagcgagtctcctgtcaacggatgtccgaggctcgccagatgaacacggatttggtgtgttctgcctgtttccagctctaattcaacgagcgacagccgttctttcgcattgctgaccattaccttgaaatgagtgacggctgtttgcccgcctggtgaaacccggcgtcttgtcgggtgtgatcggtctctgccgatcggtgaattaattgtcccttttttcgtccgtagcttaccttcagcgatggcggtatacgtacgcttcagcgtctttttctctaactgctggtctaagatggcgtgtgccaaacgatgcttggcaaaaacgatagcgccagatgtatcctgatcaagacgatggacgtggcgcaccttacatgtttcgccatttatctgataatgatacgcgatcaaattagccagtgtgccggtttgcccatcctcattcggatgcgttgcgatgccagcgggtttattgacgatgagcatatgattgtcctcatataaaatatcaagctcgccatactccggaatgaccgaagatgcttcactttcctgaagatcaatgaacacgcggtctcccttttttacaatcatattgtttaagacggattcgtgattgacctttatctgttgatgggacatccagtcttgtatcactggtttagaagctttgagcgctgttttgagtacggaaaacagccattggccgtcctgtttttcattgatgaggatctcaagccctctgcctttttggttcatgttaaatggctccttttcgaagcggaaggctgctgtttctcataggaaacacttaccttagctttcgcgtttttttctgtgctattcttgagtaagacttaggatattcgatggcaagaaaggtgattgacgtgagaattgtgaacgcagcaactgcagaacaggagagctttatcaaggagctgtctatggagctgatccatgatgtatttcctctttatttctccgaactggacattcagcgctttaaaaagaaaggcgttctgtctttaaataaccattattaccaaggaacattaaaagaagcatttcaaattatggcttgtctgcaaatgatacatattatcctgaccaagccttcgccgcactctgatttgagtgatcaggcgatttttgaaaaaaacagcaagatgctgaatgattttgggatttattttccgtttgctttttctgactttcaaaagaagactaacaaagcctttttcggtcaaagaaggctaatataatcatgcggcaagggcttttctatttttagaaaagctctttttgtatcagagaaatcatatcataaaacctttcctctaactccctttttaaacggctcgtgtctgaacatactaatgattgaaaggggtgctgacaatgagttcagttaaagatacaatgacaacgcaggtggcaaccgtttctccgaatcaaacgattcaggaagcggcttctctaatgaaacagcataacgtcggggcgatccccgttgtagagcaaggtgttttaaaaggaatgctgactgaccgtgacattgcattaagaactacagctcagggccgtgatggccagacacccgtttcagaagtgatgtcaacagaactcgtatcaggaaaccctaatatgagtctggaagacgcgtcgcagctgatggcccagcaccaaatccgccgccttcctattgtagatcaaaacaatctagtcgggatcgttgcgcttggagacctggcagtcaatcagatgtcgaacgagtctgcgggatcagcgctgacaaacatttctcaccaaaacattcattaataagaaagagcttgcagtgtgcaggctctttcttcacataaaaccttactttttgaaagcggacttgtttcggggtatagtgagtgtatacatatgtctcaattcgtactaaaggagttgtacccagtgattaaagcgttaatttttgattttgacgggcttattctagatacagaaacacacgaatatgaggttcttcaggaaatatttgaagagcacggctcagtgctgccgctatctgtctggggaaaggtcatcggaactgctgcgggtttccggccttttgaatatttagaagagcagatcgggaaaaagctgaaccatgaagagctcacacaattgagaagagagcggttcgccaaacgcatggaaacagaaaaagcgagacctggtgtcgaagcgtatttgaatgcggcaaaggatttaggcttaaaaataggccttgcctccagctctgattataaatgggtgtccggccatttgaagcaaatcggcctgtttgatgattttgaagttattcaaacggctgatgatgtggaagaggtgaagccgaatcctgaactctatttattggcggcaaagaacctggggtatcgccagcggaatgtctcgcgtttgaggattctgtcaatggttcgattgctgcgaaacgtgcaggaatgaagtgtgtcattgtcccgaataaagtaacgggcaccttgatgtttgaagactatgatcacaggcttgaatcaatggcggaaatggagctcgccctattgcttgatcatctgaactcacaaaactagaaaggagcgagtaggttgtctgagaaattagatttgacccggtttgaaaagaaaatggttatccgcaatatcgaagagaaagacatcgacaagattatcgatcttcaaaaggactgctttccggggatggaaccttggaagcgagagcatttaatcagccatttggagcattttccagacgggcagttttgtgcagaattcgaaggtgaaattatcggttcgtgctcaagtctcctgattaactttgatgaatatgatgaccgccatacgtggcaggacattacagatgacggttatatcaccaaccataatcctgacggcttgaatatgtacggaattgaagtcatggtgcacccgaaatacagacgaatgaagatcggccaccgtttgtacgaggcgagaaaggacttagccagacgcttaaacctgaaaagcatcatcataggcggacggattccaaactatcacaaatatgcagatgaaatgacagcgagagagtatgttgaacaggtgacacgccaccaaatatacgatccggttctttcttttcagctgatgaacggctttacccttatgcgaattaacccgaattatctcccagatgatacagcttcgatcaagtatgcgacgctgatggaatggaataatgtcgattatctaccgcagcagacaaaacgctattataaatcggcgttccctgttagaatttgtgtgatccaatacgaaatgaagaaaatttattcctttgaggaatttgcgaatcaagtagaatactatgtcgatgttgcttccgacgcaagatctgattttgcggtgttcccggaaattttcacaacccagctgatgtctttccttgaggaacggtcaccgagcttggcggtgcagagaattaccgagtatacagaagattacatcagcctgtttactgacttggctgtgaagtataacgtcaacattatcggcggatctcatttcgtcgaagaggaaggcaagatctataatatcgcttacctgttcagacgggacggaacaatcgaaaagcaatacaaactccatattacgccgaatgaacgcaaatggtggggatcagcgcaggagaccaagttcgcgtgtttgatacggactgcgggaaaatcgcgatccagatctgttatgacattgaatttcctgagcttgcccggattgcggctgataaaggagccaaaatcatctttacgccattttgtacagaagaccgtcaaggctatctgcgtgtcagatactgttcgcaggctagagcggttgaaaatcaaatttatacggttatctctggaacggtcggaaaccttccgcaaacggaaaacatggatatccaatacgcccagtcaggcatctttgccccgtctgattttgaattcgcccgagacggcattgtcggcgaaacaaacccgaatattgaaatggttgtcatcggcgatgttgacctggaaattctcagaagacagcgccaaaacggtacagtgcgccagctaaaagacagacggcgtgatatttatcatattcaatataaaaaataattcccaaaaaacccgcctgaattggcgggttttttaaaacaaaagcggaattgtttaggtgctttctttaaaaaaagtaaattgtatagtggaggagccttatggagtttctgtattttcgccatttcctatatcatacagaaatcggctaggcttccattgctattgcaatggctgtccaagttgtttcgagtgcgacctttatcagtacgatgctgagcattgtcactttgcctgttttgctttggaagctgcatcctctttcttcttgagaaagggatgttttattatttacgcggtttattgactctgacccggtctggctttatattgaaggcagggaaatcatcaccaagacatcacataaagagaaggtctgtttcaattgaattggcattatagggaacgctaatgaaatggagatgatggggatggaaaacattcagcaaaatcaggtattaaagcaaaaagatgagcaatttgtgtggcatgccatgaagggagcgcatcaagcggacagcctgatagcccagaaggctgagggggcctgggtaaccgacatagacggacgccgctatttggatgcgatgtccggtttgtggtgcgtcaacattggttacggcagaaaggagcttgcggaggctgcctatgagcaactaaaggagctgccttactacccgttaatgcaaagtcacgcacccgcaatccaactggcggaaaagctgaatgaatggcttggcggcgattatgttatctttttttccaacagcggatcggaagcaaacgaaactgcttttaaaattgcccgccagtaccatctgcaaaacggcgaccacagccgttataaattcatctcaagatatcgggcataccacggcaatacattgggagcgctctcagctaccggacaggcgcagcggaaatataaatacgagcctttgagccaagggttcctgcatgcagctccgccagatatataccggaatcctgatgatgcagacacgcttgaaagcgcaaatgaaatcgaccgcatcatgacatgggaattaagcgaaacgattgccggggtcattatggagcccatcattacaggcggaggcatcttaatgccgccggacggatatatgaaaaaggtggaggacatttgccggcgccacggagcccttttgatttgcgatgaagtgatctgcgggtttggacggaccggcgagccgttcgggtttatgcactacggtgtgaagcctgatatcattacgatggcaaaaggaatcacaagcgcgtatctgccattgtcagcgactgctgtgaaacgggacattttcgaagcgtatcagggggaagctccttatgaccgtttccgccacgtgaacacgttcggcggaagcccggctgcctgtgccttggcgttgaaaaacctgcaaattatggaggacgaacagctgattcagcgatcccgcgatcttggagcaaagcttttaggtgagcttcaagctctgagagaacacccggcagtcggggatgttagaggaaaagggctactgatcggaatcgaactcgtcaaagacaaattgactaaagagccggctgatgccgccaaagtaaaccaagtggttgcggcgtgcaaagaaaaagggctgatcatcggcaaaaacggcgatacagtcgccggctacaacaatgtcatccagcttgcgccgccattttgcctgacagaagaggacctttcctttatcgtgaaaacggtgaaagaaagctttcaaacgatataatataaaagtgatttattaaaggagcacatgatgagttttcacaaccagccgatcttaccggctattcgcaatatgaagcaatttgatgagtttttgagcagttcgttctcttacggtgttattcttgatattcatctcgggcagctgaagggcgtgatcaaagaagcgcaaaagcacggaaagaacatgatggtgcacgtcgatctcattcaagggattaagcatgacgaatacggtgcggaatttatatgtcaggatattaagcccgctgggattatttccacaagatcgaacgtgattgccaaagcgaagcagaagaaaatttatgccattcagcgcctgtttttgcttgatacaagcgcgatggagaaaagcatggagtttatcggcaagcataagcctgacttcatcgaagtgcttcccggcatcgttccgacactcattcaggaaataaaagagaaaacagggattcccatctttgccggggtttcatccgtacggaagaggatgtagagcaggcattgaaagcgggggctgtagctgtcacaacatctaataccaaattatggaaaaaatatgaaaactttttgacggaaaatgattgacaccgctttcatgcactgatacaattgcactaggttaatacattgtgatggagaactcggagaccacagcagctctttacggcaaatgtttatgcacccgtaaagcggtttgttgtggtttttttattctcttcttctctatcatgctttttaatcgtgactttaggaggaatgtgctatgacagcattttggggagaagtcatcggtacgatgctgcttatcatttttggtgcaggtgtttgtgcaggtgtcaatttaaagaaaacgctttcattccagtctggctggattgttgttgtatttggatggggattgggtgttgccatggcggcatacgcggttggcggcatcagcggtgcccatttgaatccggcgctaacgatagcgcttgcatttgtaggagattttccttggaaagaggttccggtttatattgcggcgcaaatgatcggagcgatcatcggtgcggtgattatctatctgcattacctcccgcactggaagtcaacggatgatcccgctgccaagctgggtgttttctcaacagggcccagcattccgcatacatttgcaaacgttttaagcgaagtgattgggacatttgtccttgtgcttggaatcttggccattggggcaaatcaatttacagaaggacttaatcctttaatcgtcggtttcctcattgtagcaatcggtatttctctgggaggcaccaccggctatgctatcaatcctgcacgtgacttaggtccgcggatcgcccacgcttttcttccgattccggggaagggctcatcaaactggaaatacgcatgggttccggtagtcggcccgattttaggcggatcattcggcggcgtattttacaacgctgcatttaaagggcacatcacaagcagcttctggattgtaagcgttatattggttgtggtattgttaggactctatatttatacgaaatcacattctgctaaaacattatcaaattcaaaatatatttaatcaaaggggagacatcttatggaaacgtacattttatccttagatcaggggacgacaagttcaagagcgattctgtttaataaagaaggcaaaatcgttcactctgctcaaaaggaatttacacaatacttcccgcatcctggctgggttgagcataatgccaatgaaatttggggctctgtcctcgcggttatcgcctcagtcatctctgaatcaggaatcagcgcttctcaaattgccggcatcggcatcacgaaccagcgcgagacgacggttgtgtgggataaagatacaggaagtcctgtctataatgcaatcgtttggcagtccagacagacgtccggcatttgtgaggaacttcgtgaaaaaggatataatgataaattcagagaaaaaactgggcttttaatcgatccatacttctccggcacgaaggtgaagtggattttagacaatgtggaaggcgcaagagaaaaagcggaaaaaggcgagctgttgtttggaacgattgatacatggctcatttggaaaatgtcaggcggaaaagcgcatgtgaccgattactccaatgcctcaagaacactgatgtttaatatttacgatttaaaatgggacgatgaactgctcgacattctaggcgtaccgaaatccatgctccctgaagtgaagccgtcttcccatgtgtatgcggagactgttgattatcacttcttcggaaaaaatatcccgattgctggagcggcaggcgaccagcagtccgcgctgttcggccaggcatgctttgaagaaggcatggggaaaaacacatacggcacaggatgtttcatgctgatgaataccggggaaaaagcaattaagtccgaacatgggcttttgacaacaattgcttggggcattgacggaaaagtgaactatgcgttagaaggaagcatttttgtcgctggctctgccatccagtggcttagagacggattgagaatgtttcaggactcttcgcttagcgaatcttatgcagagaaagtggattcaactgacggcgtgtatgttgttccagcatttgtcggactgggaacgccttactgggacagcgatgtgcgcggttcggttttcggcctgacaagagggacaacaaaagagcactttatccgtgcgacactggagtcattggcttatcagacaaaagatgtgcttgacgcaatggaagcagattcaaacatttcattaaagacgcttcgtgtagacggaggagctgtaaaaaacaatttcctaatgcagttccaaggagacctgttgaatgttcctgtggagcgcccggaaattaatgaaacgactgcacttggcgcggcttatttggcgggtatcgctgtgggattctggaaggaccgttctgaaatcgcgaaccagtggaatctggataaacggtttgagcctgaattagaagaagaaaaacgaaatgagctgtataaaggctggcaaaaagccgtgaaagcagctatggctttcaaataaagtaatactatggtataatggttacaagttaataagaacggtcctgagatgaggagagaccacagcaccaaagtgtaagcatgcactttggctgttgtggtctctttttctatttaccgtgacaacaaggaggaaacgtaatgatgaaacatcaattttcaagtcttgaaagagatcgcatgctgacagacatgacgaaaaaaacatatgacctatttattatcggaggaggaattacaggagccggaacagctcttgacgcggcatcaaggggaatgaaggtcgcactaagcgaaatgcaggactttgcggcgggaacatcaagccgatcaacgaagctggtacatggcggcttgcgctatttaaaacaatttgaagtgaaaatggtcgctgaggtaggaaaagagcgggcgattgtgtatgaaaacggcccgcatgtcactacaccggaatggatgctgcttccgtttcataaaggcggcacatttggttcatttacaacatctatcgggttaagagtttatgacttccttgcaggtgtgaaaaagtcagaacgaagaagcatgctttcagcaaaagaaacgctgcaaaaagagcctttggtgaaaaaagacggcttaaaaggcggcgggtactatgtggaataccgcactgacgatgcgagactaaccatcgaagtcatgaaggaagcggtgaaattcggggcagagcctgtgaattactccaaagtgaaggagcttctttacgaaaaaggcaaagccgtcggcgtattaattgaagatgtgctgacaaagaaagaatataaagtgtatgcgaaaaaaattgtcaatgctacaggcccttgggtcgatcagctcagagaaaaagaccattcgaaaaacgggaaacatttgcagcatacaaaaggcattcaccttgtatttgaccagtctgtctttccgctgaaacaggctgtatatttcgatacacctgatggccggatggtatttgcgattcctcgtgaaggcaaaacatacgtgggaacaacagacactgtttacaaagaggcgctggagcatccgcggatgacaacggaggatcgtgattatgtcatcaattcaatcaattacatgttcccggaactgaatatcactgcgaatgacatcgaatccagctgggcggggttgcgtccgctgattcatgaagaaggcaaagatccttctgaaatttcacggaaagacgagatttggacatctgactcaggcctgatcaccattgccggcggaaaattgactggatacagaaaaatggcggagcacatcgttgatcttgtcggtgatcgcttaaaagaagaaggcgaaaaggattttggaccatgtaaaacgaaaaacatgccaatctctggcgggcacgtcggcggttcgaaaaatctcatgtccttcgttaccgcaaaaacaaaagaaggaattgcagccggtttatcagaaaaagacgcaaaacaacttgcgatcagatacggctctaacgtagatcgcgtctttgaccgggtagaagcgctgaaagatgaggccgcgaaacgcaacattccggttcatattcttgctgaggcagaatacagtatagaagaagagatgactgcaacccctgctgacttctttgtccgcagaacgggacgtttatttttcgatatcaattgggtaagaacatataaagatgccgttattgattttatgagcgagcgattccaatgggatgagcaggcgaaaaacaaacatacagaaaacctcaacaagcttttacacgatgcggtcgtaccgcttgagcaataaatcataacgggctgtctgcagcccgttatttctttttacgtagaaagggccagatctcaggttatcaagtgacagaggcacccgcttcatataaaataatggcataagctgatacataggaggacgaatatgacttggagaaagagctatgaacgctggaaacagacagaacatttagacccggaattaaaagagcgccttattgaattagaggggaatgaacaggcccttgaggactgtttctataaagaccttgaattcggtaccggcggaatgcgcggggaaatcggcgccgggacaaatcggatgaatatttacactgtgcgcaaagcatcggccgggtttgcggcatacatctcgaagcaaggtgaggaagcgaaaaaacggggcgttgtcattgcttatgattcccgtcataaatctccggagttcgcgatggaagcggcaaaaacacttgcgacacaaggcatccaaacatacgtgtttgatgagcttcgcccgacgccagagctgtcattcgctgtcagacagctgaacgcttatggggaattgtggtaacggcaagccataacccgcctgaatataacggctacaaagtatacggggatgatggcggccagctgcctccaaaggaagcggacatcgtcattgagcaggtaaacgcgattgaaaatgagctgacgatcacagtggacgaagaaaataagttaaaagaaaaaggcttaatcaaaatcatcggtgaagatattgataaagtttatacagaaaaactgacgtccatttctgtacatcctgaattatcggaagaagtagatgtaaaggttgttttcacaccgctgcatggaactgcaaataaaccggtcagacgcggtcttgaagcactcggctacaaaaatgtaacggttgtcaaagaacaggaactgccggattcaaacttctccactgttacatcgccaaacccggaagagcatgcggcattcgaatatgccattaagcttggggaggagcagaatgcagatattctcatcgcgacagatcctgatgctgaccgcctcggcatcgcggtgaaaaacgatcaaggcaaatatacagtgctgacaggaaaccaaaccggagcgctgctgcttcattacctgctttctgaaaagaaaaaacaaggtatcctgcctgataacggtgttgttctcaaaacgatcgtcacaagtgaaatcggccgtgctgtagcttcttcattcggccttgatacgattgatacgctgacaggctttaagtttatcggtgaaaagattaaggaatacgaggcatcaggccagtataccttccaattcggttatgaagagagctacggttatttaatcggggattttgcccgcgataaggacgccattcaggctgcgcttttggcagttgaagtttgcgcgttctataaaaaacagggaatgtcattgtatgaggcgctcatcaatctctttaacgagtatggtttctatcgtgaagggctgaaatccctgacgctgaaaggcaaacaaggagcagagcaaattgaagcgattcttgcttccttcagacaaaatccgccgcagaaaatggcgggcaaacaggttgtcacagcagaagattacgctgtaagcaaacggacgcttctgactgaaaacaaagaagaagccatcgacttaccaaaatcaaatgtattgaaatacttcctggaagacgggtcttggttctgtcttcgtccttctggaactgagccgaaggtgaaattttattttgccgtaaaagggtcatctttggaagacagtgaacagcgtcttgccgccctttctgaagatgtaatgaagacggttgatgaaattgttgagtcgacggcaaaataattcaagtatgagctgggtcattgtaaatgatccagctttttctttttctcattcaaaagtctgaaagaaaatcatcctacaagtgaagcaatgaaatacaaaaaactggtataatcttaaatacaagatcaatgccggagtgagaaacgtgagcaaaacgaggatggaaaaattaaaaacgctgaaaacgattgcggaaaccttaaatcaagggcacgatatcaaagcaacactggatgaggttttaaaagagttgctgagtctgacaaaccttcaatccggatggatttttctgatcgaagaagatgggtcttatgcgttagcggccgacgcttatctgcccccggctttaagccgcaaggaaaaagtgctgatgtgcgaaggggagtgttattgcctgacgaaattcaataacggagggcttagaaaggctgcaaatatcatgaactgcaaacgcatcgaatcagcagaaaacctgcattgttttgacacagaagggattacgcatcatgcaactgtgcctttagaagacggggacagaagattcggattgttaaatgtagcggcggccggaaaaaccatgtttgatgaggaagagctgcatttactcgagtctgtcgcctttcagatcggaacagcaatccagcgtatgaggctttctaaatatcaacaaaaaaatgctcttttaatggagcgtaaccgcctcgctcaggagcttcacgattctgtcaatcaaatgctgttttccgtcagtttaactgccaaagctgcgaagacactaacaaaagatgagaatttacagcagatgattgatttcatccaaaacctatcacaggacgcgctcgcagaaatgaaagcgttaatttggcagcttcgccccggaggattggaaaaagggctggctgaagccattaaaagctatggtgcgctcattggattgaagatcatttttacacaaaaaggctgtcctgttctgactgatgagcaggagcatatgctatggcgtgtcgtacaggaagctttaaataactgcaaaaagcatgccggaacggatacggcgtatgtcagtctgagggcttctttgtgccatgcggagctggatataatcgatcatggggcaggatttcgctatgaagcgcatgccggtctgccttcacttggcatcaagggtatgaaagaacgggcggaaaaagccggcgctaagttttggattgagtcagcgcttggaactggaacaaagctgtccatcaggcttccgctaacaagccgaaaaggaggggcggtatgaaaattgtcattgctgatgatcatcatgttgtcaggaagggtctgcgttttttctttgccacccaggatgatattgaagttgtcggagaagctgcaactggaatagaagctctccgtgttatcgaagagacaaagccggatcttgtgctaatggatctgtctatgcccgagatggacggcattcaagccattaaaaaagcaatacagcaatttccggagacgaatatcattgtgctaacgagctactctgatcaggagcacgtcattcccgcgcttcaggcaggcgcgaaggcgtatcaattaaaggatacggagcccgaggaattggtgaaaacactaagacaagtgcatgctggcgaatacaagctttctacagctattatgccccatgtgctgacacatatgaaaaatcagcacgacccggaaaaagaaaaatactatcaattaacaagaagggaaaaagacgttctgactgaaatagcaaacgggaaaagcaataaagaaatcgcagccgccttgtttatttcagaaaaaacagtaaaaacccatgtatcgaatcttttagcaaaacttgaagtggccgatcgcacgcaagcagcgcttttcgcagtgaaatataatctgaatggagagatctcaaaatgaacatgttagtcataaatggcacgcctagaaaacatggcagaacaagaattgctgcatcctatatttcagctctgtatcacacggatttgattgatctaagcgagtttgtattgccgatttttaacggtgaagctgatcaatctgaactgttgaaggtacaggagcttaagcaacgcgtttctaaagcggatgcgattgtattattatcgcctgaatatcacagcggcatgagcggcgctttaaaaaatgccttggattttctaagcagcgaacaattcaaatataagcccgttgcattattggcagtagcgggaggcggaaaaggcggcatcaatgcgctgaacaatatgagaactgtgatgcggggtgtctacgccaatgtcattccgaagcagctggtgcttgatccggtgcatattgatgttgaacatgctacagtggctgaaaacattaaggaaagcttaaaagagcttgttgaagaactcagcatgttcgcaaaagcaggaaatcccggcgtctaaacgccgggatttgtttatgtgagaagggctatttgatcttcataagtcagctctgtggcatgatcaatataacggagaagggaatacagcatcttttctaaaacggcgtaatcctgttcaaaatgatacgcatgcagaaaatactcaattcgttttgacaacaaatcgtcctctgtacgcaccattaaaattaataaattatcccattgagaacgatgggtgtaataaagcgctttatcgtaatcggcataatccatgaatcgcttctcctttcttgggtgagaagttcatgattagtttatgccgcatcctctgtaattgacggggcaaaacttggcgtctgcggcagtaaaggggtagcaatatgagggagacataaaatcaaaatgcctgaatgaagatatcgcttttggtaaacctatgagggaacatattctgggtacaggagactgaaaaaatgaaatctctgccgtataccatcgcacttcttttttgcggattgattatcgtgtcaatggctgcaaaaggtcattcaacggacacaaacgagtccgttcaaaagtgggaacagcttgcctggagcaaaattcaggatgaatataaggacgcttcattttctgattatgcttatatggggcgtacagaggtgaatgatcagcagacgaaagatgtctttcgggtaacagtcagacagaaagatgacactttttctgttcgggccgaagtctattttcatccggtgacaaatcatatgatcagcatcaacgtctttaggctctaataaaaaactgtacagccgttaaggccgcacagtttctgtttttagaaatatcgttttgcaccgagatagcgctgtttccagtaagagttgttcatattggaaatgacaactccggaatcgttggcatttatgaattccccgttgcctaggtaaattccgacgtgggaagggccggctttatatgttgtaaagaaaacgaaatctccgacagcaggctggctaactgatttcattgtgttccaatatcccgctgccgttaatctagatacggaagtgactttgttcagtacatagtaaatgaatccgctacagtcaaacccggacggtgtcgtgcctccccagcgatacggaaccccaagctgcgctttagcggccgaaatcattgtgttaatcttcgcactcgttgagctggtggtgtttgaagaaccggatgaagacgatgatgaagcttttccggaaatgaccagcttttggccaacctgcaagacatccgtttttaaattgtttttctcacgaatctgctgagctgttacattaaatttttgagcaatcacccataaggaatcaccgcttttcaccgtgtatgtagtcgtcgtgccggagcttgcatttgacgaagaagacgacgatgatgaagagcctgaagatgctttacctgtcagcttcaatacttgtccaacgtaaagcacatctgatttcagattgttgatatttcggatttgctgtacagtcaggttatagttgtttgcgattttccaaagtgaatcatcgcttttaacggtatatttagttgttgctgaagtttggttcgatttggatgaagtgtctttagaagacgtatcagagccgtttgattttgttttcaacacctgattcacgtaaatggtgtctgattttaagttgttcaagaccttcaattcagcgatggacatattgactttgtttgcaattttccaaagtgaatctccaagctgcaccttatatgttcccgtagaagatgaggaacttgaactcttattagaactgctttttgaactggagcttgaactcttgttagagttgctttttttactggaactagagcttgaagaaacagtaccggacacctttaatttctgcccagcacgaattaaatcgctgcttagtccgtttaattttttcagttcctgcaccgtcattttaaactcatttgcgattagccaaagtgaatctccgcttttcactgtgtaaacagaacttccgctcttcttggttgttgagcttgaagtagatgaagaagtgctggatttgctgcctggaatagtaagcgtctggccgatcgacagaacagtagtcgaaagatgattggcggatgtgagggccgccacacttgtgttataggtttgggccagtttccataaagaatctccgcttttgaccttaatcgttgctgcttcagctggtgtcactactaaagttgtgccgacaatcgcagatgctgtcagccctgctgctaatttctttttcatcttagctctcctttttccccaatgattttgcatttgctgtttcttttttatatcggcacatttgtctcatcgttttgcctttttataaaaatagccaaattatcttaacaataagggggaaaaagggcataaaaaaagaaggaatcatggatctattccttcatttttaaaagcttcatgatatcttccttgtttttgacgaggtcgcgcagtgtatatttgtctaaaaccgcaagataggccaaaagcgcttcattcagcacatgttttaagccgcaaaccggggaaataacacagagattcttgttcgcatcaaaacattcaacaatattaaaatcgtcctccgtttttctgacaacttcaccgatgttgatgtcttcaggttccatgcctaatcgtatgccgccgccccgtccgcgtatcgtttctacgtagccgagctggccgagcctgtatatgactttcatgagatgattttttgaaatagaatacgtttcggcaatctgttttatatttgaaagttctccgggacgctctgcagccagaaaaatcaacactcttaatgaataatctgtataattggttaacttcataataagacctcagaataagacattttctatatcttatcataatcgattgaaaaatgaaaaaaaaggaattaaaaaacatgcacccagctgggtgcatgttttttgcttacatgtcattcggcggattttggtttttacggtttttttcgatttctgtgttttgcattttgcgttcaaatgtagacagataacgtgatgcaaaatccttaccgccaaggccgaaggataaaccgaaagcgagtgcgaagccgctaagaacgatgatgaacgcggaattgacgattgtcgcagcgacaccaagctgatccagggccataaagaaagcaagtgcgataatcgtatatttagcaataggcgctaaagacttgaattcctggccttttatcatgcttgagagcacttttctcaccaattctcctgcgtaaaggccgagtccgagaataaatactgcgacaaggacattcggcagatacgcgatgatgccagtggcaatttctacgaggaagtgcagccgaacaatttgaagcgcctcagctgtaaagagcagaatgacaatgatttgcgcaatcataccgacaacttgagacaaggacagctttgcaggcgttccggcttccatgcccattttccctaagacagaatcaaagcctgcgcgatgaagcagtccggacaccatggatttcacccattttcctgcccagatacccgctaaaacaagcacgatggcaatcatgatgttcggaagcatgtttaaaatcgtattcagcatagagacagccggttttgaaatgccggcgacatccagctgatcaagcgctgaaataaccaccggaatcataatcagcacataagcgattgttccgatgactgctgaaaggcttgtatcttttaagtaaattgataaacccatacgtgccgcgaatctttccgtgccgatgcttgcaaggaaattcgtaatgatatcacgaacaaggcgggcaacaagccagccgattaatacgataagcgctgctgcaaataatttcggcagaaaagcgagcacgctttccatcatatttgtaaaaggacctgaaatgccgctgattttcaaagaagataagacccctggcagaaaaacaagcagcacgagataaaagacaatttgtgaagcggtattgacagcctggtgaatatcttttccttcagacaccaaattccacttgcgcagtttgtcactcgtgttcagcttcatcccgatttttttgacaaggaagctcaaaacagaggctgcagcccatcctaacagcagaatgagtccggctttcagcacgcttgggatcgcagctgcaatcgccgaaagcatactgacaaacggcgatgccactgttgtcaggtgcaaaatgttaaagaataaaataaagacgatgatcagtgcgataaaataaacgaccttgcttatgactttttccgaggaatagcgtgaaggctttttcccagcaaagagcttgtcgtcgatttttgttttgctgagtcctttgtataccgctttttcaatgattttagcaatagcccagccgattaataagacgagtaaagcaatgattacgtttggcagcttactgagataagaagaaagcacgtctgctacattcaattggtatcgctcctttttcgtagtatggtgtgtgtttacccactgatccaataagcaaacagatgaatgtgccggggaattttttcttgcccgagtgagactatcatcttttgtctggcgggctcatacattatagataagtccaagtaggggggattcggttgaacgcggaggagaagaagggattacagcgggcaattgaggaaattaccgaaattgcaaaaggattcggccttgatttctacccgatgagatatgaaatctgcccggctgaaattatttatacatttggcgcgtacgggatgccgacaagattcagccactggagcttcggcaagcagtttcacaagatgaagctgcactatgatctagggttaagtaagatctatgagctggtcattaactcagatccatgctacgcttttttgctggacagcaactcactgatccaaaataaattgattgtcgcacacgttcttgcccattgcgatttcttcaaaaacaactgccgtttccaaaacacgaagcgcgatatggtggaaagcatggcggcaacggctgaacggataaaacactatgaacaggttcacgggattaaagaagtcgaatcttttttagatgcgatcctttcgattcaggagcatatcgatccgtcgttggtccgaccaaagctccaatggagtgtggatgatgatgaagaggagattgaagaggcagccacgccttacgatgatctatggtctttggatgaaaagaaaccgaaaaaacaagtgaaaaaatcgaaaaaaccgttcccgccgcggcctgaaaaagatatcctgctttttatcgaggagcattcccgggagctggagccatggcagcgtgatatattaacgatgatgagagaggaaatgctttatttctggcctcagctggaaaccaagattatgaatgagggctgggcttcctattggcaccagcgaattatacgtgagcttgatttaacctctgatgaagcgatcgagttcgccaagctgaatgcaggtgtcgttcagccgtccaaaacaggcattaatccttattatttagggctgaaaatatttgaagacattgaaaagaggtacaacaacccgacggaggaaatgaagaaaatgggcgtgcagcctgactccggccgggagaaaatgtttgaggtcagggagattgaatccgatatctctttcatccgcaattatttaaccaaagaattagtcatgcgcgaggatctttatttgtttcaaaaacagggccgagattataaaatcatcgataaacagtggaagtcggtgcgcgaccagctcgtaagcatgcgggtaaatggcggttttccatatttgacagtaaatgacggcgattatatgaaaaataacgagctctatattaagcattggtatgagggcatagagctggatttgaaatatttggagaaggtgctcccttatttattccagctttggggaagaagcgtgcacattgagtctgtgcttgaggataaggaagtcatgttttcgtacgacggaaaaggtgttcaccgcagatatttataaaaaagaggatgcagcgttctgcatcctttttattttccagtttttaaaatcttaaatatgatgtttgcctggtccgtattgttaatcaatccgcggaatttttcttttccggggccgtacgcgtataccggtacttcttcgccggtatgatcggtactcgtccatccgctgttggagcgggtattaaaaatcttgatgatggctttgtaggcccctttgcttttgtcagcctgtgcagctgcttcaacgcttttgatttcttcagatgtgaatttcagattggcatagcgggcgagcacatctttagccggcttgccttcactgatttttttggccatgaattcaggtgttttcttagcggagagaatcggttctgcgtgccaattcttttccccgtttgcgccaatggtaaagccgccggttgtatggtcagcagttgcaatcacaagtgtatgtttgtcttttttcgcaaattcaatcgcggctttataggcctgttcaaaatctttaacctcgctcatggctcctactgtatcattgtcatgggccgcccagtcaatctggctcccttcgaccatcaagaaaaatccttttttattttggttcaggcgatcaattgctgaaaccgtcatttctttgagagacggtgttttgctgtcacggtcgagcgccttagcaagccctccatctgcgaaaagcccgagcacctgctgatctttatttttcttcaatgcttgtttcgttgtcacatagctgtagccggcttgtttgaattcctttgtcaagtttctgtccttgcggttaaaataagattttccgccgccgagcagcacgtctattttatgtttgccttttattttgtcatccatatagctgttggcgatttggtccatgtttttccgtgattcattgtgggcaccatatgcggctggagtggcgtggttaatttcagacgtggcgacaagccctgttgacttgccttgctgtttggcctcttcaagtactgattttacttttttcccgtttttatcgacaccaattgcattgttatatgtcttaacgcctgtcgctaatgctgttccggctgctgctgaatctgtaatattatagtcagggtcatccggatgcgtcatcatcatgcctgtcaggttccggtcaaattctgttaacttcgggttattcggtgtgtcaccgttatttttcatggaacggtaggctcttatgtaaggcgtccccatgccgtcgcctatcatcacaatgacatttctgatctcagctttgtcttgttttttggcgctggccttttctgtttgctgcagctcagctccggcaaagattccagctgtaaggacagaaacagcggcgattggcagaaattttgatttcatattttgaaacaaattcatttttttcatgcctcctttaatgtattccgtttatcatgttagggaaattttgttaaatgcggctgttgattatgtaaacaataagtaaagccttgtaaggaaatgaaaaaacgcttttcgttatcttgccttatttgatgtaaagcattcatttttcagaaaaatctttacctctctgtctttgcatgatatgtttgtttaaataaaaaaactgcggataaccgcagctctcctcgaatattctttaccactcatttttccggtatgtgagccgaccccgaaagtttttcatttatttcctttatgttgaaaaacatcccataaaacatgacaaaagcactcgttttttgtcacctttgcaacgaaaatgaaatatttaatacccttaaaaacttttttttagaacgaataattaagaaatttgtcacatgaagtcaagactatttctgatgggaatctatccttataatagaaatcaataagattaatttaaaaaaagagatacatatatagagagttaacatttggggaggaaaatatgaaaaagcaaatcattacagctacgacagcagttgttttaggatcgacgttatttgcaggagcggcatctgcacaaagcattaaggtgaaaaaaggcgacacgttatgggatctttcaagaaaatacgacacaacgatcagtaaaattaaatcagagaaccaccttcgttcagacattatttatgtgggacaaactttatcgattaacggcaaatctacgagttcaaaaagcagcagttcttcttcctcttcttctacatacaaagtaaagagcggggacagcctttggaaaatttcaaaaaaatacggcatgacaatcaatgaactgaagaagctgaatggcttaaaatcagatttgcttcgtgttggacaagtcctgaaactgaaaggttcaactagttcaagcagctccagctcatcaaaagtgtcatcgtcttcaacttctacttataaagtgaagagcggagacagcctttctaaaattgcgagcaaatacggcactacggttagcaaattaaaaagcttaaacggcttaaaatcagatgtaatctatgtcaaccaagtattgaaggtgaaaggaacaagcacaagcagctcaaaacctgcttcatcttcatcatcttcaagtagcaaaacgtcatctacatcacttaatgtgagcaagctggtttctgatgcaaaagcgttagtcggaacgccatacaaatggggcggaacgacaacttccggctttgactgcagcggattcatttggtacgtactgaataaacaaacaagtgtgggcagaacaagcactgcaggatactggagttctatgaagagcattgccagcccgtctgttggtgatttcgtcttcttcacaacatataaatccggcccttctcacatggggatttacattggaaacaacagtttcattcatgcaggatctgacggcgtacaaatcagcagcctgaacaacagctactggaagcctcgttacctcggtgcgaaaagattctaattttagagaaaacccgttcattggaacgggtttttttattagacggagcataggcgttttggttgctcctaaaaatgaaaatgtgataaaaaatccaagaattttttttctttcttattttcataaagggcaatcgcgtaagcgccggcatagggcagctgtacagactgataaggaattctgatcatctgtttctctgctaactcacgctttactgtagataaaggcagaaatgaaactccgagtccttccttgataaaccgtttcgttatatgtgtttgagtgaccttcattgttctcacaaatggaaatgtcattctgacttgacggagcaagtcgtcccagtaatcaggatgattgtgggtcaaaagcaggtattgttcgagcacctctttggcatcaatttcgttgtcttctatgaaacgcttatcgggcggggcaacaaggacgacagggtctttgtataagcagtggcagcttaaagaagaagactgtacctttaaacagcttagtccgatatctgcttccccggctttaatcagtgacgcgatttccgctgattcgaaaatcgtaaccgccatttctgtttccgtattcattgctgtgtaccgcttcatgacagaaggaagcacagtatctgcaataagcggagaaaccgcgagctgtaaggtttgagagtagccttgtctcactctgtgaagctctgccatgctgttttcataatcatcaagaagcctgagcgcatacggcaaatacgccctgccttcatcagtcagctggatttgcctgcctttacgctcgaacagcttgcagctgatttctttttctaattgcttgatatgtacggtcacagtaggctgagataagaaaagcgtttccgccgtttttcggaagttctcatattttgcagcggtcacaaaggtgtgaagccatttgaaatccatttctattctccctctgattaatatttttaattaattccctttaaaatattcattattttttaaatattatatttactataataacagaaaaggatagggggaatacaaatggtacattacggattaaagggaattacatgtgtggaaacatccatcagccatattgatggtgaaaaagggcgtctgatttacagaggacatcatgcaaaagacatcgcactgaatcacagctttgaagaagcggcttatttgattttatttggaaaactgccttcaactgaagaattgcaggtatttaaagataagctggctgcggaacggaatcttccggaacatattgagcgcttgattcaatcactgccaaacaacatggacgatatgtcggtgctgagaacggttgtttcagcattgggggagaatacgtacacattccatccgaaaacagaggaagcaatccggctgattgcaatcacgccttccatcattgcatacagaaaaagatggacgcgcggtgaacaagcaattgcaccttcttcccagtacggacatgtcgaaaactactattatatgctcacaggtgaacagccttcagaggcaaaaaagaaagcgcttgaaacctatatgattctggccatggagcacggcatgaacgcatcgactttttcggcacgggtcacgttatctacagagagtgatttagtgtcagccgtcacggctgctctcggtacgatgaaaggtccgctgcacggaggtgctccttctgcggtgacaaaaatgcttgaagacattggagaaaaggaacatgctgaagcatatctgaaagaaaaactcgaaaaaggagagcgcttgatgggattcggccacagggtgtacaaaacaaaagacccgcgggcagaagctttgagacagaaagcagaagaggtggccggcaatgaccgtgatcttgatcttgcgctgcatgtagaagcagaagcgattcgtttgctagaaatctacaaaccgggacgaaagctgtacacaaatgttgaattttacgcagctgcagtgatgagggccatcgattttgacgatgaattgtttactccgaccttttcagcaagccgaatggtagggtggtgcgcccatgtactggaacaggcagaaaacaacatgattttccgcccgtcagcgcaatataccggtgccattcccgaggaagttctttcataacatattttggcgtttattcatttctgtcgtgtggtaacgttcagtatcaaccacatgtctaggagtgatgaatgtgaacccaatggacagacaaacagaaggacaagaaccgcagcatcaggacagacagccgggcattgagtcaaaaatgaatccgctgccgctgtcagaggacgaggattatcgaggaagcggaaaactgaaaggaaaagttgcgatcattactggaggcgacagcggaatagggagagcagcagctattgcctttgctaaagagggggctgatatctccattctatacttagacgagcattcggacgcagaggaaacacgcaaacggatcgaaaaggagaatgtccgctgcctgcttatcccgggagatgttggggacgagaaccattgtgaacaagctgtgcagcaaacagtggaccattttggtaaactcgatatcttagtgaacaacgccgctgaacagcatccccaggacagcattctcaatatttcaacagaacagctggaaaaaacctttcgcacaaatattttttccatgtttcatatgacgaagaaagctttgcctcacctgcaagaggggagtgccattattaatacgacatcgattaccgcttatgaaggggatacggcgttaattgattattccagcacaaagggtgcgattgtttcctttactcgttccatggcgaagtcgcttgcagataaaggcatcagagtgaatgcggtggcgcccggtccgatttggacaccgcttattccggcgacattccctgaggaaaaagtgaaacagcacggcttggataccccaatgggaagaccgggacagccggttgagcatgcaggcgcctatgttctgctggcgtctgacgaatcttcctatatgacagggcagaccattcatgtgaatggaggccgttttatttcaacgtgatcaacgaaaaaccagctccagagctggtttttttgtgtggtgaaaaatttcaaaataaaaaatttgtcgatttttctaacaattttgttttcatttttgcaattttatatataatattgagtaggagaaaggaatgattcgcgaccagtacaaatatagtagaaaaaaagaaaaatgaccattgttgctcatgaattcagaaaattcaaataaaatatataaaaatagatgatcgggagttgaaggggaatgaaagggagcgtttttaggaagaaaagcattcaggatttaatcgctgcgacgagcggggaaaagtctttaaaaagagaattaggggcatttgatttaacgttgcttggaatcggcgccattattggcacagggatttttgttctgacgggaacaggcgcagtcacggccggtcccgggctgacgatttcatttgttgtggcggcgttggcttgtttattcgccgccctgtcttacgcggaatttgcgtcaagtgtgcctgtttcaggttcggtgtatacattcacttatgcgacattgggagagcttatggcctttattatcgggtgggatttaattttagaatacatgctggcggtaagtgcagtgtcggtcggctggtctggttatttccaatcgtttttatcagggcttggcattcatcttccggttgctttaacagcggcaccgggcgcagtgaaaggcacctttaccctgtttaatcttcctgcattcgtcattgtaatggcgatcacatatttgctttatttaggcatcaaagaatcaaaaagagtcaacaatatcatggttatcttgaagatactggttgttctgctgtttatcgcggtggcagccgtttacgtgaagccgcacaactggcagccgtttatgccaatgggctttggcggcgtattcagtgcagcggcgctcgtattctttgcttttatcggatttgacgctgtatcctctgctgcggaagagacgaaaaatcctgcgaaagatctgcctaaaggcattattttctctttactggtctgcacgattttatatgtcaccgtatcagcgatcatgactggggttatcccgtttgctcaatttgcgggtgtggatcatccggtttctctagttcttcaaagcgcaggacaaaactgggtggctggcatcattgatattggcgccgtgttgggaatgacaacagttatgctcgtgatgctttacgggcagacacgcgtcatgtttgccatgtcgcgtgacggacttgtgccgggctcactttctaaagtgcatccaaagcacaaaacaccttatgtagccacttggtttttcggaacgatgtcggcgcttctcggctcacttgttccgctggatgaacttgcaaagctggtaaacatcggaacgttgtcggcatttgtcctgatttctgtggcagttatcgttttgagaaagaaacagcctgatcttccgagagcttttaaatgcccggagttcccgtgatcccaggcctggcgattctgttctgcctgttcttgattttaaatctgggatgggtgacgattgtccgcttcctagtgtggctgttaatcggcttggtaatctattttctgtattcaagaaagcattcaaaattaaatcaataaccttttgataaagagagcgtccatacaggccgctctcttttctgttcttggcaaatgaatctatagaaatgaagacaaaaataagagataatataggctggaaaggaagtgacgtttattgtctgagcaaaaaccagtccaatgggcttcgaaaatcggtttcgtcatggcagcggccggctcggctatcggcttgggcgcgatttggaagttcccttacgtagcggggaccaatgggggaggagccttttttcttatcttcgtgttatttaccatcctcttaggctatccgcttttggtgggggaatttatttttggaagacggaaccagacgaatgccattgatgcatataaaaaagaagcgccgcgatcagcttggtttcttacggggtggatcggcgtagccgcgtgtttcttagtgctgtcgttttacagtgtaatcgggggatggattttgctgtatatcgtgaaaacagcgtcaggatcactgtccgggctttctcaagcacagtatggcgctctttttgcttctattatccaaaatccggtgcagacgctcgcggctcagcttgtctttatggcactgactgtactcgttgtcgcaagaggggttcaaaaagggattgaacgggtaagcgcggtgatgatgccgattttgtttttattgtttattctgctcgttcttcggtctcttacgcttaatggtgcaatggaaggcgtaaagtttctgcttgtgcctcatttcggcgatttgactccggaatccatattattcgcgctgggacaggccttctttacgttaacactgggggtttcggtgatggtgacctacagctcctatttgccgaaaacacaaaatatccctcgttcggcagcctccattgtcttgatgaatatcattgtgacactcttggcaggtttggctatttttccggcggttttctcattcggttttcagccgaatgaaggaccgacattgctgtttacagtgcttccggccgtttttgaacagcttccgttcggcacgttgttttttatcggctttctcgttgcatttttatttgcagccttaacctcagcattttcgatggttgaaattatcgttgccacaatcggaaaaggggacgaaaagaagagaaaaaaactgtcatggacgagcgggcttttgatctttttggtcggaatcccatgctgcttgtcttatggcgttttgagtgatgtgcacctatttggcaaaacgttttttgatattgccgattttaccgtcagcaatgttttgatgccttcaggcgctctgttaatttctctatttatcccgctgaaaatttcgaaaagcgaactcttggctgaaatgcgaaatggatcaaatgcaggtaaagcattcttttacacatggttttatttgcttcgttttatcgtgccgcttgccattattatcgtgttcttaaatttaatcggaattttatcattttaaaaaacaggctccgtttccggggcctgttttttatttaataagatgatatcaacggtgcccatgccgttttcagtttttggatgccgagcctgatgtcctcttctgacaaaccgccataaccgattaagacagaagtaaaaggcgtctgttctatatatgagggagacacgggatagagggttacaccgtggtctgcggctgcttttattgcttcttcctcacttgctggaaacaaaaggcgcagcaaaatgtgaagccccgagttcttaccgagaatctcaacggtgtttcctagttcagagcggatggcttctaacaggacagcgtgtttttttcggtataagcttctcattctatttatgtgtttttgccactctccggtttcgatgaagtctgccagtgccaattgcgagtgaacagagacggtctgcttcattaactgagcattgtttttgatcggttccatgagttcagggggcacaatcatgaagctgagccgcaaggaaggcagaagtgactttgaaaaagtgcccagatatatgactctgccattcggatcaagaccctgtaaagacggaatgggatggccgctgtagcgaaattctccatcgtaatcatcttctataatgaatgaatttgtttctgccgcccatgccagcagctcctgtctgcgggtaatcgtcataatggtcccaatcggaaactgatgcgaaggagtcgtatacatgagataaggtttctgacgatagagctcatccggcaggacgccttctgcatcagaacaaatcggagtgacatccatgtgatttgcttcaaacatccttcttgaacggtgaaagcccggttcttcaaagccgatttttgtaccttgctttagcgaaaggcaaagaatttgcagaagcacggtggttcctgcgccgatgataatctggccgggttcgcaatttactccccgagacagcctgacgaatcgggcaatcatgtgcctgagttcgtattctccttgagggtcgccagaggtgtgaaacgatctggaatagcgatcaagactttttactatgctttttctccatgcgttaaagggaaagagggtcggatcaacgttgccctgatggaagtcaatagcaggtgcgttcttttcatgtaatcccggctgtacagactgctgaaaatggtcaggagctgtcgggaatcctggttctacttccgccgcgaaccagccgattttcggcttgcttttgacatagccctcagcagttaattgctcataagcccgttctatagttgccgtgctgacatcgagcaagctggagagcctgcgttttgacggaagtcttgttccctttgttattcgcgcatgtgaaatttcttgtttaaaaaaggtataaagctgctcatacagcggtgttttgctctttttatcaagaaacggcgtaatatccatctcatgtctccttatatctggcatggtcattttttctgatattggctatttggctaatgccatttattagctatgatcattgtaacgaaaggaaaggggattgagaagatgatccatatgaaacaattaacctcgaaagaagaatgggctgagtcgtatccgattatgagtgaattgagaacagaactggatatagagacgtatttacaaaggcttgaagcctgtgtgcagaaagaatcgtatatgctgtttgccttatatgaaaatacagcaatcagagcgctgtgcggggctctgccgagagtttccattcataaaggagagcacttgtggattgcggatcttgttacaacggcaccttgccgatcaaagggatacggcaaaatgcttttggattatgcctcagactgggcgagaaaagccggacttggttttgtcagtctttcatctggccttcagcgtaaagacgcacatcgattttatacagataaaatgggttttactatagaaagttatttgttccgaaaaccggtgtaatgaaaaaaagacgcctgaaaaggcgtcttttttaaaagccaaactgtaaattcgtatctacagatacaatggtatacacacaaataatcacaaagagattaaggatgacgccgagcaggcctggacctgtgcgccctctcttgatgaagagttcaacaacgccgaacggaacggcagccatggcgaacggaagcatttgataggaataaaacgtgacgttgctgataatggccaaattcagcaacagcagggacagaaccgctgtcccgacagagatccagccgaatacattgtgttctttaaaaattcttaccagttccataattccacctcgccgacattcgctgattttacagatttatttttcagcatgcgctggatttccttggttggccctgtaacgaccgaaccgtatacattgacaccgtttttctctacataatctaatcggttatctacattcaggtctttccgttttgaaatgacctgagcccatttttcgtgtttggacatgaatttcagggcgttgataaactgatcgccattcgacttgccttttgtattaagggcggccaagaactttgaatcctttccaggatagccaagaggttctgtggaagctgtcttatttgtgtttttctctgtttcgattgcgttccacaaaaagctcacatcatagcctttgaatttgttatacacgtcttttgtcggatatgcacggtcatatgaaaggtagacctctgataccgttccttcaggcaatgtgcttaacgttttttctgcttttgcggtcgtttgttcagacttgtttgaaggatgtgtaaagtaatggccggttttattcacttctaagtcatagtagtttactgccggcgcttttactttgttataaaacatttcaacccgttcattccctacggcagccgtcttcgtgccaatctgcttttgcagcgggaattccgtattcatcccaaatagcttcacttggcttttcagtccggaagtatcaacaagaacattcggcatggtcagggctacagtgactgcggcagtttccataaactcattgccggtgctgtgttttccacccattccgtaatagaggtagcttcccagcgtacaaagcggcaaaatcatcaatgtcgaaatgacggcaagcacagaaattcgcaaataagacttgcgtttgccgtaggctaaaatcgctttttgtttttcaggactgatgctgagatcccaatcgttatcgtcctcgagttcgctgtcaatcagttcctgatatacttcgagcttctcaagttcttcctcaaatgcagtcatttcctggtcgctcatttccccatttttatattgatcaaaacgctttttaaattcttcattcatcattaacacctctattataaagtgctttcagccgctgtctggcacgaaataaaacacttttaaaattcgcctctgaaatattcataatatgggatgcttctttgtagtttaactcttttaaataatatagcgttaaggcctcccgataattatcggggagctcggacatataaccagtcagcacttcctttatctctacctgatgggcaggactttgaacagcattttgaaagaggcttccgattaagtcatcagaaatggttacttctttcttatgctttctgacgtaatcaatgaaggcgtttcgcgccacttgaaaaagccagggctttactttgctgtgatcataggagtgaatgtgtatgtatgcccgcataaaggtttcctgcagtaagtcttcagcaagatgcttgtcttttgtcatggagagcaggaacctgtaaacatcattcatgtacatttggtaaatttcatcgatcgtcactgccttttctcccctctatgttatacacgcataagaaaggtttaaagttgcacattacatgcaaacggcttttttatacctaatcaaacaccattactatatagtacccaaaaatgcccgcaaaagatagtgcggagaaatgtttaacattttttccagaggggaaaagatagtgaaggagtggcacaatggaatataccagtatagcagatacaggaatagaagcctccagaatcggcctcggcacatgggccattggcggaacgatgtggggaggcactgacgaaaaaacatcgattgaaacaatccgcgccgctcttgatcaggggattacactgattgacaccgcaccggcttacggcttcgggcagtccgaggaaattgtcggaaaggcaatcaaagagtacggcaaaagagaccaggtgattctcgcaacgaaaacggctctggactggaagaacaaccagctgttccgccatgcgaacagagcgagaattgtagaggaagttgagaattctttgaagcggcttcaaacagactatattgatctttatcaggtgcattggcccgatccgcttgtgccaattgaagaaacggctgaagtcatgaaggaattatatgatgcgggaaaaatccgggcgattggcgtcagcaatttttcaattgagcaaatggatacatttcgcgccgtcgcacctctccatacgattcagcctccatataatctgtttgaaagagagatggaagagagtgttcttccttatgcgaaagataacaagataacaacattattatacggcagtttatgcagagggctgttaacaggcaaaatgaccgaagagtatacatttgagggcgatgatctgcgtaatcacgatccaaaattccagaagccccgctttaaagagtatctttctgctgtcaatcaattggataagctggcgaagacacgttatggaaaatcagtgattcacttggctgtcagatggatcttagatcagccgggagcggatatcgctctttggggagcaagaaagcctgggcagcttgaggccctatctgagattacaggctggacgctgaacagtgaagatcagaaagatatcaatactatattggaaaatgcgatatcagaccctgtcggaccggagtttatggccccgccgaccagagaggaaatataacaaaagctgagggcgaatcctcagctttttggcgttttaacgggagaaatcttaaaaattagtaccaggtaataaaaaatgttgttataatagatgacagaaagaatcattgattacgacaaaggaagtgcgatatgtataagttttgtgcaaatgctttaaaagttattctttctcttcgcggaggagtgaaggtgtataacaaagaaaaccttccggccgattcaggttttgtcatcgcgtgtacacattccggctgggttgatgtgattacactcggagtcgggattcttccttatcaaatacactacatggcgaaaaaagagctttttcaaaataaatggatcggttcgtttctgaagaaaattcatgcctttccggtagatcgggagaatcccgggccaagcagtattaaaacgccgattaagctgctgaaagaaggagagatcgtcggtatcttcccaagcggaactagaacctcggaggatgtgcctttgaaaagaggtgcggtgacgattgcgcaaatggggaaagcgccgcttgtccccgctgcatatcagggcccttcaagcggaaaagaattattcaaaaaaggaaaaatgaagctgattatcggtgagcctcttcaccaggctgattttgcccacctgccttcaaaggaaagacttgcagcaatgacagaggctttgaatcagcggattaaagaactagagaataaacttgatcagctataaggcgttctgagagattgccctgaaactgtgaaaataagaaaagcaccttatacaaggtgctttttattatgcttcctgctggttagctgtctccagaagttcttcttcttgaagctttttcacttcaatatatgcgacgtggtggccgtcaatttcattaatgatgaattcgcagccctcttcgatgatggaatcatctttttcaacatcgtatttttgagtaaggaaccagccgccgattgtgtcgacttcttcgttctctaaatgaatgcctagcaggtcgtttacttggtcaattaacacttttccgtcaagaatataatggccttcgccgattttgcggatttcgctaatttcatcaatatcaaattcgtcgcggatttcaccgacaatttcctcaatgatgtcctcaaccgtcacaagcccggcagtaccgccgtattcatcagacaatatggccatgtggaccctctctttttgcattttgacaagcaggtcttggattggcgcagattcaatgacatgaatgatcgggttgacgaattgagaaatggtggaatcaacagatacctcaccgcttatgcaggcggtcagcacttctttaatgttaataaccccgataatgttatctttatcgccctcttccacagggtagcgggtatatttttcaatctgaatgatgtccatcatttcagaaatcttgatatcatgcggaaggctgacaatttcggtccgcggaatcataatttctttcgcgagcctgtcgtcaaattcaaagattttattcacatatttaaactctgattggttgatttcaccgcttttatagctttcagacaaaatgatacgcagctcttcttctgagtgagccagttcgttttctgaaacggtctccaggccaaatgctttggtcaataaccgtgcagaattgttcaaaagccaaatgaatgggaacgcgatgcggtaaaaccaaatcagcggtttcgcaaacagcatagacactgcttccgccttttggatagcgactgtcttaggtgcaagttctccgacaacaacgtgtaagaacgtgataatggcatacgcaaaaataaacgatatgacatgtgaaagggaacctggaacgttcatttgtacgaaaagcgggtgaagcagcctttcaatcgttgattcacctaaaacccctaatccgatggaagtcaatgtaattccgagctgacacgcagataaatattcatcaaggtgcgtggtcactttttttacggctattgctgctttatttccttccgcgatcagctgatcgatccgtgagcctctgattctgataatggcaaactcagatgccacgaaaaatgccgtcagggcgattaaaacagcaactaaaatcaaattcactatgtccaattagaaccttcactctagcaatgagaatgaaggtaacacctcctgttagataaaatggttttaacttaacagcagcataaatgattggaacacggcgagcttttcaggcgggagtttgcttttcagcttgtcacgatcctcgggcttcagccgttcaaaccgatgcaagattccggagatgttttgattcatatgatcaatttctaatgccagatttccaatttcatcatcaagtttagctgaagagggaaactggttctccagtcgatctttaatatcggacagggccaatcgctgcttcttgcaatctacaataaatataagtcgtttgagtgcattttcgtcgtagtaacggtaatttgaacaggatctggccggcgtaagcagaccaagattcgtataataatcaactgtccgtttcgttactccggcgagtgccgctagttcactgatgcgataagtctcagccccatctatatccctcccaaccatcacgttatagttatgagaatagtttaatatatgaatggtgtcttgcacaagtttattgtttttttagaccggaattggaagttgtggaattcatcatctgattgaagtaacataggaagatagaattttcaaatttttatatgcggaagggacagatgaaattggctgggttatcccgggaagttgaagaaaacttaaataaaggatcatggattcgcaagctgtttgatgaaggtgcaaggctgaagaaggagttcggggaagaccaggtatttgatttttcactcggcaacccgattgttgaaccgcctgaagcttttaagagagcgttaatagaggaagctgaaaaaggcagccacggatacatacaaaaccaagggcttcctgcagcgagagaaaaagtcgcgcaatttctggggtcgcgttttgaagctgatttctcagcggagcgtatcgtcatgacggtgggcgcgggaggcgctttgaatgttgcgttaaaaagcatcgtaaaccctgggaagaggtcattattcttgcaccttattttgccgaatataagttgtatattgagaactacgggggaaaagccgtcagctgcccgttgacaagccggtttgagatcgacattgaagcggtaaggcaatcgatcactccacagacgaaagggctgatcctcaatacaccgcataaccccacaggcacggttctcagccagaaaaatatagacgatttaggcgctttattaaaagaaatagaagagaagagcggccagacgatttatgtgctgtttgatgaaccgtacagtcaattaatctatgatgaagagctggcaaatccgtttcaatcgtaccatcgtgtgatattggctagctcattcagtaaagatctcggcatagccggggagcgactcgggtatatcggattggacagccgaatgccggatgcggaccttttgatcaacgcttttgtgtattgtaatcgaacgcttggatttgtgaatgcccctgtcatgatgcagcgggctgtggcacgaatggatgatttaagagtagacgcgagcgcttataaagagcgccgggatttaatggtagacattttaaaagaagctggttttgaatttgaaatgccaaagggaggtttctttgtttttccgaaatcgccgattgaagatgaagttgcattttgcgtgcatgccgcccaaaaatacaaattattaattgtgccgagcagcggttttggaatgagcgggcatttccgattatccttcagtgtgccgatcgagcagattaaaaactcacgggacattttcatttctttatataaagattttgcttaagaaggcaaagaaaagaaaacagttttcaaggctgttttctttttatatccgcaaaatccttcctcttccaatccagacaggcgcagaattgacaagcaggcatgcagttaaggctttcctcatgataaaagtctaaaaattaaaaatcatttttggaatgagttgtgttacaataaaatatacaatttataatcaaactttgacttttggaggtggtatgatggggccctctgcttaggcaacaatacaccgcgtacctcaatgttaaggaaaaatgattatatcaggaggtgactccttatcctttgttgagaggatagggttaaatggacgatattgacagtctgattttaattggcgtgctcattgctttaaccgcgtttttcgttgcaagcgagtttgcgattgttagagtaaggagatccagaatagatcagcttatcacagaaggaaacaaacgggcgatactcgcaaggcgtgtcattacagatttggatgaatatttatccgcatcccagctaggcattacattgacatcaatcgggcttggcgtactgggtgagccggcctttgaacggctgctgcatccactgtttgaaccgctcggcttgccggactcggtttcacatgcagtctcttttgcagtcgcgtacggcttgatcacgttcctgcacgttgttgtaggtgaactggccccgaaaacggtcgcgattcaaaaggcagaacagctgactttactgatagcgggccctttgcgtttattctatttgctcctgtttccgtttatttggatcctcaatggatcggcgcggcttttatgcgggatgttcggtttgaagcctgcgtcagaacatgatggttcccattctgaggaagaactcaggatgctgttatctgagagtttaaaaaacggagagattaatccgtctgaatataaatatgtgaataagatttttgaatttgataatcggatcgccaaagaaattatgataccgcggaaggaaatggctgctgtgtcaactgagatgacgatggccgagatgcttgaagtcatgctgaaggaaaaatacacgcgctggccagtcacagatggagacaaagacagtgtgatcggtttggtcaatacgaagcatttgttttctgatttgctgtttatgacagaagaagaacgaatgaagatgacgatccatccgtatgtgaggccggtcatcgaagtgattgaaacgatcccggttcatgacttgctgattaaaatgcagcgcgagcgcattcatatggctatattgtcggatgaatacggaggaacctcgggacttgtgacgacagaggatattcttgaggaaattgtcggagagatcagagatgaatttgatgaagatgaacagccgctgatccaaaagcttggcgacggccattatgtgatggatggaaaggttcggatcgatcaggtgaacagccttcttggcgcatcgattcaagaagacgtcgatacgatcggcgggctgatattaaaagaaaacatcgatattgaggctggtgaatccattcgcatcggttcatatacgataaaggtgctgaagatggacggccgattaatcaagcaaatcgatataaaagaagaagccggcaacacaaccgggattacggcgcaccacaagctgccgctgcccgagcctgtgatgctgaacagtgcaaccttgagcgagaaataagctcaaggtttttttacattgtgattgtccagccgcaccaaaatgccaaaagcgacccgcaaagtgtcagggcgatgtacaagatgctttctattacacgtttggccataaggagttgaatactttcaacgctgaaagtggaaaaggtcgtaaaggcgccaaaaaaccccgtgccgatgataagcgaggccgaagcatttgtaacgtgaagtcctgtaaatattccgagcccgagagctccgagaatattgactgtcagtatgccaatgggcaggctcagacctttggttttggcggttatgacattgccaagccagaagcgaagcattgcgccaagtccgccccctatgaaaatacccgctagtgtcatctttcctgcagcccctttctttgctgaatgcctgctatgcgccgtcccgcaaaaacaccaatcagtgcaaatatgatccctgatatcaatgaggctgccacatataaaagagccaatgagggttgtccttgcaaaagcatcactgtttccttagaaaacgtggacattgttgtgaagcctccgcaaaagccggtgcctaaaaaagccgacagcagaggccgttttgcaccgatcataaaaaatccggtcaaaatgcctaatagaaggctgcctgccgcattttccagccaggttgccgccgggaactgaccggtgtgtatccataagtttaatccgtatcggaggcaggcgccaagcgcgcctccgataaaaaccgcgctatatattttcatgtttgccatcctttatgatgaaatccgggtaatctgtaacgatgccgtccacgcccatggcttgtaattttgccgctgtcttttgattgttgacagtccatgcaaatatgtttaagccatttttatggacggagccgatcatcagacggttgagccgtgtgtattttatattgacatagtttgcaaaagagcggaaggccttcatctgatttctggacagcatgccaaagttgggccttgtaatgaccgctgtcggaatcgaaggataaagctcgtggaacctttggacggagcggaactgaaaggattgaacaatattattgatagaaaaagaaaattgccctaatagctgtcccacctcttcttcaattccgacttgagacggatggccttttagttcaattaaaaggccgatttttttgtggtagcgcttgagcaccgctttcagggtcggaatacgctctccttgaaaagcgggaccgtaccagcttcctgcatcgagtttttgcaattcctccaaggtaaaatccttaacaaagcccgatccgtttgttgttcggtcaaccctgtcatcgtgtatcacaacaatctgcctgtcttttgtaagctggacatccagttcgatcatatctgcattcattttcaccgcaaggtcaaatgcggcaatcgtattttccggagcgtagccggatgctccgcgatgggcaatgatgtacaagctaagtcagctcctcgtatgggcatttctgttattgtatcaaaaccatatatgcaccgcgatacaaactggtgaattttttctgccatatcggaatggtccgggctgaggaatgcgtataactaaaaaaagacactcagcgtatcagaacacatttcgtcagaaaattaggtctttcgacatgttcacaacaaaatatgatcctttataatagcaaaaaaggaggcgagatcatgggaaaagggagaatcagagtggaggaaagaattaaagccgaaacggatgctgaaatgcaaaaagcaactctccttgatcagacacaaacgaaaaaaggtaagtgactgtccctattgaatctggctgatagatgaattgagaaatgacccggcgtttcgccggggttttgtgctgcaaaagacatttaaatgaacatctttacgaatattttagtataataaacaattgattgggatagaggggagacagtcatgccggattatctgcagcagtattttacgcttgatatcatcattcaaatcggcatcagcttggcgattttgctggtgtttcttatacttagaaaattattcacaagatatttctttaacctgctttttaatttgacaaaccggccgaaaacagaaatttttaaacaggtggttctggcgtttgataagccggccagatggttttttgttgcccttgggctgtttttagcgatccggtattcaccgtttttagatgagcaaatgtcggtcatcagcaaaatataccgctcactgattgtggcgctcttgtgctggggtctttgtaatttgaccgcaacatcgtcgtttatcttccataaggtgaaccagcgcttcgagcttgacatggatgacattctggccccgtttttatccaaattgctccgttttgtgatcattgcgctcagtgtcagtgtgatcgctcaggaattcaattatgatgtaaacggatttgtagcgggccttggtcttggcggactggcttttgcgcttgccgcgaaggataccatcagcaacttcttcggcggtattatcattattactgaaaagccgtttacaattggtgactgggtggagacgtcgacagtaacaggatcagtcgaggatattacctttaggagcacgagattcagaacagcacagggggcgcttgtaacggtgccgaactctacgctgtcgatggaagcgatcacgaactggacaagaatgaccaaacgccagattacgttttccatccatgtgtcctacgctacgccgattgagaaccttgaacgctccattcattctctcagaacaatgcttttagagcatgagggcgttgataatgaaacaatcatggtcaactttgatacgtttgccgacagctactacaatttattttttaacttctatacaaaaacgacagtttgggctgaaaaccttaatattagagaggatatcaactataaaattattgagattttaggtgcagaaggtgtccagtttgcatatcccggccaaatggttgttgtcaagcaaaagcacgaaagcgacccattccaggtgaatctaaataaagaggaaaaggaacgggcttaaaagagagacttcgtctgacagaggcggagtctttttcatggtaaaataagagaaaaaggcggtgttgagttggaagcattcaaaaatattctacatgaagcacagagaattgttgtgctgacaggagcgggaatgagcacagaatcagggattcccgactttcgttcagcagggggcatttggacggaagatgcctcaagaatggaagcgatgagccttgattatttctcaagtcatccgcgtctgttttggcccaaattcaaagaattgttccagatgaaaatgagcggcagctttgaatcgaatgaaggacacttgcttttagctgagctggagaagcaagggaagcaggtcgatatttttacgcaaaacattgacggtcttcataaaaaagcggggaacaggcatgtatacgaactgcatggttctatccagacagcagcttgtccggcatgcggcgcccgatatgatcttccccatttgctggagcgggaggtgccggagtgcacggcggccggaaacaatggggacatttgcggaacggtattaaaaaccgatgttgttctctttggcgacgccgtcatgcactttgacaccctttatgaaaagctggatcaagcagatcttttattggttatcggcacgtctctcgaagtggctccggctagatttgtgcctgaggatgcaagtctgattcccggcatgaagaaagtcatcataaaccttgaaccaacgtattgcgacagcttgtttgacatggtcatccatcaaaaaatcggcgagtttgcccgaagtttgggcataaaaaagtgagccgccttatgcgcctcacttttttattcatgaacaggaaccattgtgtcctctaacactccgaaggaatagcctttttcttttaatttattgattagtaccggcagcgcgtttacggtagcgggaagatcatgcatgagaatcacattcgggcggcctgaagagctttgttccatattttcaagctgctctaacacggccgtcacatactttgaatttcggtatttccagtccatgctgtcaatcgtccaatcccagtacacaaaaccgtctttctcaagattgcggatttgtgagggggttagtgacggcttgcttccgtagggcgttctgacaagagcggttttatatcctgtaatgtcctgcagcgtgtcacgcgcctcctgcatttcttttaacggagatgtcggtgattgatagaataatctgttattgtgggtaacgccatgtaaaccgagtgcgtggccttccttttctgctcttttcacagcttgtttgaattcgttcatccgcggtgacagcataaaaaacgtcgcttttacatcagcgcttttcagtacatcgagcaagcggtttgtaaaggctgacgggccgtcatcgaaggttaagtaaaccgttttatctcccatgtcctgctttgtctgcagatgttttatcagcagatcgggggagtcgtttttcagcttaaggctttccttctcatctcgaagctgtccgttagttgtgacagtgacttcctttgctttcgttgaactgttggaataacccaaaatcaccataagcaaaagcagcacacataaaactgctaaacttgcaaatttaaaagcaagcgaaactgcagaaggagaagcttctcctctcgtttgtcgcataacaatctctccattggcataaaatctctacataatgctgtacagcaggcagcttatgaagatgccttatgtttacaacctatgtattaccagtcaagtatacaggaataaaactggaaagcacatagaaaagttgtcgaaatgtcagattttaaggaaaaaataaactcctttccgctatagatctcttgatctttctgtttttcagcttgtccaatatggtagaattagtgacaatgacagcttgaatgacatcagggacatctcgaaaagggagggcttttatgaaggttttagtcaatggccggctgattgggcgcagtgaagcatcaatcgatttggaagatcgcggttatcagtttggtgacggcatctatgaagtgatcagggtgtacaaaggagtattgttcggcttacgtgagcatgcagagcgttttttcagaagtgctgctgaaatcggaatttcactgccattcagtatagaagatctcgagtgggacctgcaaaagcttgtacaggaaaatgcggtcagtgagggagcggtatacattcagacaacaagaggtgtggccccgcgaaaacaccagtatgaagccgggcttgagccgcagactactgcttatacgtttacggtgaaaaaaccggagcaagagcaggcatacggagtggcggccattacagatgaggatcttcgctggctaagatgtgatatcaaaagtctgaatttactgtataatgtcatgacgaagcaaaaggcctatgaagcgggagcatttgaagccattttacttagagacggcgttgttacggagggtacttcctctaacgtttatgccgttatcaacggcacggtgcgaacacatccggctaaccggcttattctcaatggcattacacggatgaatattttaggactgattgagaagaatggaatcaaactggatgagactcctgtcagtgaagaagagttgaaacaggcggaagagatctttatttcgtcaacgacggcagaaattattccggtcgtgacgctcgatggacaatcggtcggaaacgggaaacccggaccggtgaccaaacagcttcaggctgcttttcaagaaagcattcaacaggctgctagcatttcataaatgaacgaagaaaagagcccgctttttacagcggggctctttttattttttaacaaatccaatcaaaatggagatcatcggcgatatatagaggaagaaagtaaatgggatgtagtctatgactggaacaccaagtgcgctcgccataaatgcgccgctgacgccccaaggaatcaatgggttaattaatgttccgccgtcctctaatgatcttgtcagaaattttcgctggatgttttgtttgtcatataaggatttaaatgattgtcccggtattaatatcgataaatactgttcgccggttgccaagttgacgccgatgcttgagcagacagttgctgcaacaagactgccttttgagcggatgcctttcatgacgccttccaatagtgcagaaatcaatccgattttctccatcaatccgccgagtgcaaaagcaatcataatgagagagacagagcccatcatggattgcagtccgcctctgttgataattttagcggctgcctcattgtcagtttcaaaagttgtgccattttgcaaagctgtcataaacgcctgcaggctgctgtcgggtacaaaaatagcagtcaaaattcccgaggaaataattccggcagtcagaacggggattactgatacccgtttaattgccagcaaaacgactaagagcggagaaagaagggcccacggtgtcacgtttgcagcatcttttattccggttatgacctgctgaatattatcggttgaagcagcgtccgctgacactgatgaaccgagaaagtaaaacagaacgacagtgatgagcaaagctggaatggttgtacccatcatatggcgaatgtgttcaaagatcggtatttcgcctattccggctgcaaagttggttgtgtccgacatcggcgacattttatcaccaaaacaagcgccgcatatgactgcgcctgctgtccattcaagcggaacgccggccgcgctcgccacgccgatcagcgctaccccgattgtgctaacagttgtcaggcttgagccaacaagtgtgctgatgatcatacatgaaaacaaagcagtcaacagaagatggcttggttcaataaaggatagggcataaactgtcacagtcggtatggcgccgctgtacatccaggcgccgattaagatgccgatcagcgctagaacgataatcggctgtacgccgtttttgatcccgtctacaatccctttttcaatgctcttccagggaaatccaaaccataaagctgctgctgaaagcatgacaacacttaaaaacagcgggatatgaggttctacatgaagcaagaataagcaagaaataataatgcataacatgaatataaataaaccgacggctaacggaaacgtcagctttttttgagaatccaaaataacaccccatatttatctttaatgcttttgtgcttttgggcacgaaagcattataacagaaaaaaacgaaaatctatgttttttcacaattatgaatataaaagaagtgagcacagggcgtgctcactttacaatcaggacgggtatatccgatttcgctgaaagcttttcacttacacttccgaatattagctttttcagcctgttttggtctctgcttccggttacgatcagatcggcagaaatgcggtttgcatgctcgataattgattcagccggatcgccttctaatatatcgatatctccatctgcctgctgttcattcagcatcattctggcttcggcgatgacttcttccgtacggtcttcatagatcattggctcaggtgatgttacatccgatatcagcggatcaggaacacttgtcatgcctccgcttatatagcttgcctcagctgcgggtctgggcgggtcgatgacggtctgattgtctttcatatcatgtgaatgggcgacggtaatagcggcatttacggttttagcaagatcaatggctgtcagaagcgctttcttactattttcacttccgtcaaacgcaacaatgatacggtcagcatggaacatccttctcaccctttcaaagcgtcttacaacactactacccgaatttgagcacaattaaccttttcctattcaagtaatgattgacaataaaaggttttgtttatatgatgataaaaagatgaaatcagaatggaaggagggtttgctatgccaaggaatttgcgtgtttatcaaacagtttcatattggcgcggcaaaccttttgttctgttttcgtgaacggttttttaggtcggaccgcgcgctgaaaagcgctgtgcgtaacatatcggttaaaaaaggcatggagctgacgcttcatgccttttttatatacaaaatctaaggaaagacaggtgtatgggatgtgaagacaaatacagaggcgagggctgttcgtgccaaactggatgaaaaaagctgcaaggaaaaaattgaaggcggctgatgaggagatggggatagatgttttcagttttgaaaaagcttggctggttttttaaggcgtactggctgcgctatacgattgcgattgtccttttattagcagtcaatgtcattgaaatgtttccgcctaagctcttggggaacgccatagatgatatgaaagcaggggcatttactgcggaagggctgctgttttatatcggtatcttttttgtgctgacggcggccgtgtatatcatgtcttatttttggatgcatcagctgtttggcggagcgaatttgatggagaaaattcttcgtacgaagctgatggggcatttgctgactatgtcgccgccgttttatgaaaaaaaccgaacaggcgatttaatggcacgagggacaaatgatctacaggccgtcagtttaaccacagggtttggcatcttgacgttagttgattctacgatgtttatgatgacgatctttttgacaatggggtttttgatcagctggaagctgacctttgccgccattatcccgcttccagtcatggcgattgcaatcagtctatatggaagtaaaattcatgagcggtttactgaggcccaaaacgcgttcggggcgctgaatgacagagtgctggaatctgtttcaggcgtgcgggtgattcgcgcgtatgttcaggaaacaaacgatgttcgccggtttaatgaaatgaccgctgatgtttatcagaaaaatatgaaagtggcttttattgattcactgtttgagccgacggtgaaactgcttgtcggcgcaagctatctgattgggctcggctacggagcgtttcttgtattccggaacgagctgacgcttggagagttagtgtcctttaacgtttatctcggcatgatgatttggccgatgtttgcaatcggtgaactcattaacgtgatgcagcgcggcaatgcgtcattagaccgggtaaatgaaactctttcttatgaaacggatgtgacagatccaaaacagcccgctgatcttaaagagcctggagatatcgttttcagtcatgtcagctttacatatccaagctcaacaagtgacaatcttcaggatatttcatttacggtgcgaaaagggcagactgtcgggattgcaggtaaaaccgggagcggaaaaacgacaattattaagcagcttttgcgccagtatcctctaggtgaagggagcattacattttcaggtgtaccgattcagcaaatccctcttgaccgtctccgcggatggatcggatatgtgcctcaggatcatttactgttttcacggactgtaaaagaaaatattttatacggaaaacaggatgcaactgataaagaggttcagcaagccattgccgaagcacattttgaaaaagatttgcacatgcttccgtccggtctggagacaatggtcggtgaaaaaggcgtggcactgtcaggcgggcagaaacaaagaatttcgattgcgagagcactcatggcgaatccggaaatcttgattctggatgattcactttccgctgtagatgccaaaacagaggctgcaattatcaagaacatcagagaaaaccgcaaaggaaaaacgacatttattttgacacaccgattatccgcggtagagcacgctgacctgatccttgtgatggacggcggcgtcattgctgagagaggcacgcatcaagaactgctggccaataacgggtggtaccgggaacaatatgaaagacagcagctgttcactgcggaagaagggggagcaggggcatgaaaataggaaaaacgttatggagatacgcacttctttatcgaaaattgctgatcacagccgtccttttgctaactgtcgccgtcggtgcagaactgactgggccctttattggcaaaaaaatgatagacgaccatatcctcggcattgagaaaacatggtatgaagctgcggaaaaagataaaaatgccgttcagtttcacggcgtctcatatgtcagagaggaccgattgcaggagcctgtttcaaaagcaaaagaagcgcatatttatcaagtgggaatggcgttctattttgttgatcaggctgtcagcttcgacgggaatagaacggtttctgacgggaagctgacgatcacaaacggagacaagagccgggcatatgctgccgaaaagctgactaagcaggaacttttccagttctatcagccggaaataaagggaatggtgtttctgatctgcctgtatgggggcttgcttgtgttttcggtattctttcaatacggacagcattatctgctgcagatgagcgccaatcggataatccaaaagatgaggcaggacgtgttttcgcacatacagaaaatgccgattcgctattttgacaaccttccggccggaaaagtcgttgcgcggattaccaatgatacggaggctatcagggatttatatgtcacagtgctttcaacatttgtgacaagcggaatctatatgttcgggatattcacggctttgtttctgcttgatgtgaagcttgcgtttgtatgtctggcaattgtgccgattatctggctgtggtcagtcatataccggagatatgcgtcatattacaaccaaaaaatccgctcgatcaacagtgacattaatgcaaaaatgaatgagtcaattcaaggcatgaccattattcaggctttccgccatcaaaaggaaacaatgagagaatttgaggcattaaatgaatcacatttttatttccaaaacaggatgctgaatttaaactccttaatgtcccataatttggtcaatgtcatccgcaatcttgcgttcgtctgtctgatctggcattttggcggtgcgagcctgaatgcggccgggattgtttctatcggtgtgctgtacgcgtttgtcgattatttgaaccggttatttcagccgatcacaggcatcgtcaatcagttttcaaagctggagcttgcaagggtctccgccgggcgtgtttttgaactgcttgaagaaaagaatacggaagaagcgggtgaaccggcgaaggagcgcgcgctggggcgggttgaatttcgtgatgtgtcatttgcgtatcaagaaggtgaagaggtattaaagcatatttcctttactgcgcaaaaaggcgaaaccgtagcgctcgtcggccataccggatcaggaaaaagctcgattttgaatcttctgtttcgtttttatgatgcgcaaaaaggggatattctgattgatgggagaagcatttacaacatgtcaagacaggaactcagatcccatatgggcattgtgcttcaggacccgtacttattctcgggtacaatcggatctaatgtaagtctggatgacgaaagaatgactgaagaagaaataaaaaatgcactgcggcaagtcggtgctgagccgcttcttaagaagcttccgaagggcattaatgagcccgtgattgaaaaaggcagcacgctatcctctggagagcggcagttaatttctttcgctagagctttggcgtttgatcccgcgatcttgattttagatgaggcaacggcgcatattgatacagagacagaggccgtaatccagaaagcgcttgatgtcgtcaaacaaggacgcactaccttcgtcatcgctcaccggctttcaacaatcagaaatgctgatcagattttggttcttgataaaggagaaattgttgagagagggaaccacgaggaattgatggcattagaaggccaatattatcaaatgtatgaactgcaaaagggacagaaacattccattgcataatgctcaaaaaacccaaaacaattgtgttttgggtttttggtttatgtagtcaataagccagtccgacacggtatccgacataatcacctgtaacgagctcacgatataaaaagtccgcagtatcgccgaccgaaatgcttgtgccgccctcaggcaaaacgttacgctccgtacgataaacgccggttgctgttccgtccgggaggtaagtggggcagatgattgtccagtctaatgatgattctttaagcatttcgtatacttttgcatgctccttggctgcgcgggtctgctttcgtttcgattcatttgtttcaaaccggtattttcccggttcatatcgggaatctaggatccctgcggtgccgatcgtaataagccgtttgatatgctgttcctccatagcggagagaatgtgtgccatagcagttgacaaggtatcatcaccatctgtgcctagacagctgatcacgatttcagcattttccattatttttttcacatcttctaagcggcgggcgttccccatgacggttctgtcttttgaaaggggaagatcagcatgttgagatctgatcagagcgaaaatatcaaatctttcatctgctgcagcttgtgttaaaaaggcttgtccgacgcggccgctggctcctaataaagcgattttcatcaaaaaacctcctcgcctttcattataaaaggatgttctcagtttgaacagcgcgggaaagaatacctgtacaaataaacagaacgatgggaaacatattcatgaatcatggatacacttacgaactgaaccagctcccaattcacaatggtgatgaatgacaccccgattccctccctttttttctaggatatgtggagcaggaaaaaagggtgacaaaataaagagagcgcggaaaccgcgccctctatagccatatattgaattgttattgaactctgccgcccatttgctgctgagcgaaagatactaaacgttttgtaatttctcctccgacagaaccgttagcgcgagaagttgtgtccgctccaaggttaacgccgaattcagaagcgatttcaagtttcatttgatcgatagcctgagctgcgccaggaactagtaagtcatttgaagagttttggttagccatgtgtaaaatctccttttttgtttagtatggttgggttaactggagttgcaccaatctgtgaacccttctcgggtgtcactgccgcctcggcgtaacccaatgctttgccggcttgttactacgtattatgttaaaatgtccggaaactcatgcggagaattgtgtggtaaatcttgagaaagaaaaaaagcttagccgtttaggcggctaagctagtcataaatatgaaaaagcatcagttcatgtatctcgtttgtaagagcaggctcgtcagcgcgggcgggaaacaagtctccccattcaatctcaccgctcttatgatagatgccttcataatgggtccctttataataaaatgaaattttccatccgggcagcttttcttttgggaataaaggtttccagctgaaatgagaaatcattacggccacgctccttacatttggtatcaattgacctgaatataaacggcttatgttcattgtatcattgttccagaacatcattgaagaggccttaatatgcagtttgtcccagccttggataaagataagcccgctttattaaaaaagcggacaggttacgaaggccacaatgcttcaggagatatgattgccttctcagataaatatgacgcgtattcaaagcttcttcgttttgtaagagaatcaacatgatgcaaatttggatgagaaaaaatgcttcggcccgggcgcgaattcgcttcaaacatccatactttaccgttctgatcaatgccaaaatcgaaaccgatctccccgataaacccctcgatatgatcatgaaggacatggcttgctgtcagtgccgctgcagaaagcttttttatgacctcaactctttcagcgggatcatcgtatacttccgcaagtgtctttacagtgccgccgttagaaagatgtgttgtaatgctgttctttccggaaatttttacggcgattgctgtcactgtccattttccttttctgtttttattggtatggacacggaaatccgctggtttgccttgaaattcgatgagatcaacaccttgctgaatgagaaagtcggacgggttgtgctgtttttgaaattctgcaaggaatgaggcggcatcggaataatcaatcgaagtaaatgttttggcgtcattcgtatgctttaccgtcaggccgtcatctgttcttgtcagctgataaatgccggtgccgagtgctccatttgccggtttgatatagacttttttgtatgcgccacagagctcatcaatcagctccacagacggtgtcagctcggatctaggcaaaaagggtgccgttctcggatctttttcgagcaattgatgaacgttccatttattgaaaaacgttttattaaaccatgggatctgatattcatcgatcagcctcttttttgtatgttgcaagagaagtgaatcttcaatttttcggttcggcaaacggtcataaacgacgttcggcaatggaacgatttttttctcccagccgttttccctgtaaaggaggccttcaatcgtgccttcctcccaattgatttggtgcgcgccaaaaacgaagcagtagcccccggcttgctcgtgtaacgtgacaagcttagaaaaaaagagggaacgatccttaaatggacgttcaagagatacagtaaaccctgccgtaaagatgccgactaacggcccgatatgcactgtatgatcatgaatcagtatatcagccctgcttcggtggggaagcaaaagctcatgaaacagattttcagagagaagcacggtttgttccagatgccgtctgtaagcaacgtggcatctgacaaccttcgttccgaatgcggcatgcaaaagtccgtctcgcttcagcgaagagggcagaaacagggtgttttcactggttttgtctatgccgatcaaaaaccgtttaggattcacgcggaagaactcctttctggctttgctcagaaaacagatattggcagcgctttaggggacaagtgtacagctgttctttttgctcgggagagacacgcaggattgacttcctgcctggtttggaattgatatctaaaatccaaattctcccgtcctttgcaagacatatatcaagaccgagttcaaacaacggcccatagcgctcgtcaagataatacggaaccgattgggtaatcgaaaacacatcatctagtaaaaccacttgctgttttttcggtatatcttcaaaccaggagtcaaatgtcagcgcatcagatccgcctgacaaattggcgagcaacccgtgtttgtatccgcgtcttactgcctttccgactgtattccattcacctgcttcgtttttttccataaacaggcgaatatcacaagggtattgttccttatcttgaatgtttaagtaaggctgaagcaaatattgatgctgaagcacttttttgcaccatgtcttaaaagaagtctggttggaaaacgtttttgtctgcttatcctttccgatgtgataagtagcagtgatgtttttcttgcccagcttcaaaagaatcacgcctctgcctcccgcgccgaatgccggtttaaggatgcaggctttttctttggataaaaaggagtgaatttgttcgtagcggctcacctttatcgtttcgggaatatagggattgattacagagtgctgctgcaaatcgtgaaggacggtccacttatcgggaagaccccgcccgataaattccgttttcggatattttttgagccactcaacgattggttttgctttttgtgaatgtgaatccttgccgtaaaaacagcgatcataaatataatctggaatcgccatttcagtttcgttccatgtgctgctggccgaatgatagaccgatgctttgacacgcaaagtgtcaggtgaaatatcaaatggtgtaaaccggatgaaacgtatgccgaattcgggtgctcttttggccagttctgcggaataatccgcttcatgctggcgggataaggacataaaaccgagtgttatcatggtgagactcccccttttattcaaaagctgccggcgagtgtccgcagctttacgctaaatacatgtaagacgaacgcagctgacggtattctactttacagaatacgattctccaccttgccctattccaaaagaacaagctgattttctaagaacaggaatttgtctcctcgtttgctaagtgattgcatgagcctctataatacgtataggtacataatctatatgaaaaaagctgaagcacagatggaggaagatgaataggaatgggtattgcaggaacctttatttttatgatcgtgatcggcgctgctattggagcggtgaccaatcatttagcaattcaaatgctgtttaggccgtataaagcgtactatttgtttgggaagcgagttccttttacgcccgggctgattccaagacggcgagatgaacttgcaaaacaaatgggactgatggtagtcaatcatctcttaacccctgaaggcattaaaaagcggctcgtctctgatgcagccaaaacgcaggctcttcgagtgggggaacagctgattcaaaagctgtcactttctgaagtgacagtaaaagaagcgcttgaaaaagccgggatgaagcgccccgaaaaagctgctgatgcatggatcagcagctggaccgatgataagctgaatgagcttttccgccaatacggggaccaatcgttaaaagagctggtgcctatagaggtgcaggaaaagcttgaggaaaaaattccgatgatttcaggatatatattgtcacggagtgtccgttattttgaaagtgatgaaggaaaaatccgtcttggcaatatgattgatgactttttaaaagagcgcggcatgcttggaagcatggtgcaaatgtttcttggcaattcaagccttgcggatcgcgtgctgccggagctgctgaaattcttgcggaatgaggaaacaaataaattgctttctgatctcttaaaaaacgaatggggcaagctgagggagtatacgtttaatgaagcagacgaaaaatggaatgcaaaggcgctcattttcagtttgaaacgaagaatgctgcaagcattttcgactgcccctttcttcaacaatacgattggcacgcttaccgtccgctatgaatctgagctgacccagcaaatgctgccggcactattagacaaattgcttgaagggatttcgtccaaccttgaaagtgtcttaaaacggttgcgtcttgaggaaatcgtcaaggagcaggtggatcagttcccggtggagcgtcttgaagaaatggtgctgtccatttcaaaaaaagaatttaaaatgattacctatttgggggccttctcggcggaattataggcgcgattcaagcactgtttgtcatccttttttaagaagaaatggtttttgattaatgaaaggagctccatagtctgttatagtggagtggtatgtcaaacggcaatgatgaaaggagctatttacaatggctgttaatttttatgatgtagcgtatgatctggaaaatgcattacgcgggagcgaagagttcacccgtttaaaaaacctttacgacgaagttaacgcagatgaatcagcgaagcgcatgttcgaaaacttccgtgatgtacagcttagactccagcaaaaacaaatggcaggagaagagattacacaagaagaagtgacgcaggctcaaaaaacagtagcgcttgtacagcagcacgaaaaaatttctcagctgatggaagcggagcagcgcatgagcatgctgattggtgaattgaacaaaatcattatgaagcctttggaagagctttacggcagtgttgaaggctaatcagcaaaatcccttcttggataagaagggattttttattcattcagcaaacttggaaatccaatgaatcttttacctctccattgatgatcactgataatgtatgaattcctttgtaatgctttctggtggttaaatccttaaaggattggtttcttgtgtatggcttcgtttcgttttttcgtatagttgtttcagttattttaaatactttctgatgacgctggcctcttgcttttacaaaatcaattgcgtactcaattcttactttttgatccctgtctgaatgaatagagaaagaaaattcaaggctttcgccaataactatacgtttgggctggcatgttaaatcatgtagttgtatcgaatcagcattttcataaccaaaaagcgctaaggcctgtttatcacccttttttaataaggtccgatgggcgtgtttgataatccagtctgtatggggatgtgttccgtaccattgatctgcgacttttctcagtaaatgaggatgcgtttttgatatatcattaaggttgttggccacgcttttccttacatataaggactcgtcctgcatcagcttctcaaggatcggcaatacgggggaagggtccgatttcaaagccggtatcgattttccccatggcaggcggggcctgctgccttcgctcgcaagtcttctcacgtgttcatttttatgctcagaccatgcaagcaattgtgcaatcatcttttcttgatctaacagcaaaaaaggccttacagcaaattctgaggtcgaatattgcgtaaagtattccaatgcctttattgattcttcccaatgcgctaacccgtactgttccacataatctggaaataaaattccgctgagtcctttaaaatgaggtgctgtatcccgtaaaattgcgagcgcttcaacgtattgttttggcaaagtttcgtataaagaaactgtcacgcggcgcatccgctcttttaaagtgagttcaggccagtcctccagccgtaatgtatccaagaatctgtttttgttaaaatcaggataggatgaccttacatgatggatcaactgagatatcagttcttcattatatatttcttttaaatcagccatataaaacaccgctttttcgtttattatttatattgtatgggaatgtacgttctggatcaagtgtatgatcctaaaaattaacaactgatcctaccacggatatacaaaagtcggttactttttttagttaaaaaaacccttgtcatcggaaaggaaaactgagataataacattgaaagcgcctacacttacctatttcaaatggatacggtcgcatatcatgccgttatatagaggggataagcaacagagagtaagtgttcggagcgcatcattggtcaaacaaggggttcctgatacatgatttttcgtaaatcgaaataacgatattagggagaatggctgcttcgatcgtatcctatcaacaagccatacataaagtctgctgagccaggctttttttgctttaagaaaaggttgttctaaacacagagacagggtcatatcctatacacaagtacagtcatcaaggagggggacatctctgtgtcaaaacaattgcttgccttaaatatagatggagcgctgcttcggtcgaacgggaagattcatcaggcaacgaaagacgcgattgaatatgtaaagaaaaaagggatttacgtcacacttgtgaccaaccgtcattttcgctcagcacagaaaatagcgaaatcgctaaagcttgatgccaagctgatcacccatagcggggcatatatcgctgagaaaattgacgccccgttttttgaaaaaagaatttctgatgatcatacctttaacattgttcaagtgctggagagctatcaatgtaatattcggcttcttcacgaaaagtattccatcggaaacaagaaaaaggtgaattcaaatttattggggaaagcactcattcatccgtctgacccgatcttttatccagtccagttcgttgaatcattaagcgatctcctcatggatgagccggtgagtgcacccgtcatcgaggtgtatacggagcacgacattcagcatgacattacagaaacaattacaaaagccttccctgcggtggacgtgattcgcgtaaacgatgagaagctgaatatcgtcccgaaaggtgtttcgaaggaagcgggtttggccctcgtcgcttcagagctgggcctgagtatggatgatgtcgtggccattgggcatcagtatgacgatctgccgatgatcgaacttgccggtcttggggtagcgatggggaatgccgttccggaaattaagagaaaggcagattgggttacaaggtccaatgacgagcaaggtgtcgcttatatgatgaaggaatatttccgaatgcagcagcgaaaaggatttcttgataagttccacatgaaacgtgtgtaaaaaagccgctcgcaccctgacaggtgcggcggcttttttgccggattgattttagcagtttatttctgtacactaaagaaagttttgaatctgataaattaggtgatgaagttgcaaattaaaatagaaggcatacatgatgaccgtctgcatcggcctctgcaaaatattgcaaatttgttttttgaagagtgcgagcttgcgtatggcggagaggagcccgcagattttgtcatttctttagcgttgtcacaaacggatgagcatgtgacggtttcgggagaagtgaagggaactggcataaaggaacagcatacaaaattcttttctcccggcatgaatgaaaaagaagcttttaagcaagtgaaaaacacaatttcttatgtgtatctcaatcttcttcaggcgtatacgggcattacgcagaagtggggaatcctcacaggaatccggcccacaaagctgcttcataaaaaactgcaaagcggaatgtccaaggagcaagcgcatgctgagttgaaaaaagactatttaattcatgatgaaaaaatcatgctaatgcaggaaattgttgatcgtcagctggcggcagtgccggatttgtatcgagtaaaggatgaagtcagcatttatatcggcattccgttctgcccgacaaaatgcgcgtattgcacattccctgcgtatgccatccaaggacaggcgggcagagtcggctcattcctatggggactgcattacgaaatgcagaaaatcggtgaatggctgaaggagcatgatgttaaggttacaaccatttactttggcggcgggacaccgacaagcattacagcggaggagatggatctgctgtatgaagaaatggtccgctccttcccggatgtgaaaaacattcgtgagattacggtggaggccggtcgtcctgacacgattacagaagaaaaactcgccgttttaaacaaatatgacattgatcggatcagcatcaatccgcaatcctatgaaaacgaaacgctaaaggcgatcgggcggcaccatacggttgaagagaccattgagaaatatcatctgtcacgccagcacggcatgaataatatcaacatggacttgattattggtttgcctggggaaggcgtgaaggagttcaggcacagtctttcagaaacagaaaaactgatgccggaatcccttaccgttcatactctttcatttaaacgggcgtcagaaatgacgagaaacaagcataagtacaaagttgccggcagggaagaggtttctcaaatgatggaagacgcggtagcctggacgaaagagcatgggtacgtgccttattatttataccgccagaaaaacattcttggaaaccttgaaaacgtcggatactctttgccgggacaagaaagcatctacaacattatgattatggaagaggtgcagacgattattggcatcggctgcggcgctgctagtaaatttattgatcgggatacagggaaaattacgcattttgcgaatccgaaagatccgaaatcgtacaatgagcgcttcgagcactacacggacgaaaaaatcaaatatttagagcagatttttgagaaaacgacaaagcagcactgatcacagtgctgctttttttatccctgtttttttgcgggctggacatcaggcttccatttaaataccttgttcagcaagcggtaaattcgttttgattcctttgtgacaagcggtcccaaaatcgccagaatgaggacatataatgcggcaaacggctttaatgtggctgacagtccgccggctatcccgagattcgcaacgataatcgaaaattctccccgcgatacgatcgtcagcccgatattcgatgaagccttatgagaaagccctgcgcgtcgtcctgccaccattccggcgataaaatttcccagaatggtcaaaatcactgcacccaacgcaagccaaaccgcttcaccgagcgaaaacggatcgatgctgaggccgaagctgaaaaagaacatcgcaccgaagaagtcgcgaaacggaacgacgaggtgttcaatcctatcggaatgctctgtttctgaaaagaccaaaccgagcagcagcgcgccgattgcttctgctacatgaatcgtctcggaaaacccggcgataaaaaagagcgctgcgaaaatgacgataataaacacttcgtttgagcgaatgtccaacagtttgttcaacagcggcgggagttttcttgctgcgataaaaaacagcagcatataaccgaaggcgatcaaaatggacaagagtgcactccctacggatgtcgcatcacctagcacaaggccggaaacaacggacagatatacggcaaggaaaatatcttcaaacatgatgatgccgagaatcaattcggtttccggattggcggttctttttaaatcaacgagcacttttgcgacaatcgcacttgacgagattgtgatgacgcctgcgaggatgaggacttccagaaaggaaaatccggtgataaatccgtaaagcagtccgaggctgaagttaatcaaaatataaatcgttccgccgaccgcgattgattttcctgatttgattaacttcccgacagagaattcgagtccgagatagaagaggaggaacagtacgcccattcgcccgaaaaactcaatgatttcactgctttgaataaatgttagatcaataatccctattttcggcgcgtgcggtccaacaagcattcccagcacaatcagaaacggaataatcgaaaatttaattttattggcgatcacactggcgattgccacaagcacaagtgcagttccgacttcaaatacaagatggtccatcggggctcacacgccctctccagaaagaaaatcgtgaatcagtttcttcagatgctttctctcacctgagaggacaagggtgtcattttcttcaataatcgaatcggctccgggatttaggagcttttcctggttgtgtttgataatggcaattacagtgacatcgtaattctggcggacatcaagctctccgagtgtgcgcccgatcgatttggcgcctttttcgaccttaaaccattcaataataagatcgctgaaggccatttcgatggactccagagcttgcggtttatagaccatgccccgagaatagctgcaatttgccttgcttcagaatcatccaatgaaatatttgaaagaagctcatccgggtcccggtcattaaaccggtaaatttcccttcttccgtcatcatgaatgataatcgtcattttttcgtggcttcttgtttcgatttcaaactttttgccgatgcccggcagatcgttttctttaatattcaatgaaaatccctccgaatgtagtgttggcagtatggggtgagttacaaataaaacttgagcaaattatattcggaggtaattagactggtatttgacagggacggcacaagccttttccagcctgtttatcagcggttcgtcaagtggtttgacagagagctgcctgacagactgcgccagcgggctgtactctttgatcagctcagccgggtgcatgctgcccggcgccggcgtttttgccgattgtgtttcctgcggatatgaggacataggcacatagctgtcagtgcttgcttcaaactgggaaggcagaaccacgtccgaagggggaaagtacaccataaataaacttaacagaaaactgatcagcaatttatccatgttcctttcctcccttctcgtcaagatatcccttctttttcactatataaaactttatgtttccattcaaacaatatgcatttttcagtatctattgaccttgaaaaataaaaaggtttatttgaggatggcgaggaatgtataggagaaagaaaaaagcaagcgcatacatggaggtgctttatatggagtttgttcaatatgcatgtaatggggccgttgcagagattatcctgaatcggcctgatgcccatcacgccctgaatgaacagatgctgtctgaattgaaggaggcagtcgaaatggcggctgcaagcgaggcgcacatcgttctcctgagaggaagcgggaaaggcttttcggccggcggtgatatcaggatgatgacatcagagcatgactctgatcaatttaaacggctgatggatacgattgaggctgtcaccctgaatttatatcagatgaagaaagtgacaattgcagccattcatggcgctgctgcgggactgggcctgagtttggcgctttgtgcggacattgtgctcgctgaaaaaaacgccgttctcgcgatgaattttatcggcattgggcttgttccggacggcggaggacattatttgctgaagaaaagaatcggtgaagcaaaagcgaaaaaactgatttggagcggaaaaaaactatctgcctcggaagctgccgatatggggcttcttgatgggacatttgctggagaccctgccgaaggcgcaagacccattatcgaaaccctgttggcctcccctcttttggcgatgatcgaaacgaaagctatttttcaaagcctccagattgaagaactgaaaaaagtgctatcccttgagcgcagcgcccaagagagaatgagaaggaccaaggatcaccaagaaggaatccgtgcctttttagaaaaacgggagccgaagtttcaagcgtaacagatcagccggaaagctgatcatctgtgaaacaaaatcagctttccgactgcattgactaaacgatgagtatgactatgaagctctttttcttttaagagggcttcaccatgcgtttttgctgcttcttcatgttctgcctcgaatcgctcgtttaccagcgtgttccccgaaggatcaaatacggtaaggaagtaatcagccatcaggtttctcctccattttaaggtttatcagtctttcttcatttatattctaaaaaggaaatcaaaatcctttattatgctttatccaaaattagtatataatgggtcagggaaggaggagattcagtgcttacaattgatcacgtaacgaagacatttggagattataaagccgttgacggattggacttagatattccggaacagcaaatgttcggtttattaggcgcaaacggagcgggaaaaacaacgacgtttcgcatgatcctaggattattaagcattacggagggctcaatcagctggaagggccgtcctgtgaattatcatatcagcaacaaaatcggttatttgccggaagagcggggcctttatccgaaaatgaaggtaagggatcagctcgtctatcttgccagattaaaagggatggagaagcgagaggctgtaaaagagctcgggacatggcttgaacgcttcaatattactgattacgagaataagaaggtggaagagctttcgaaggggaatcagcagaaaatccaattcatttcggcagttttgcataagccggagctcctgattcttgatgaaccattcagcggcttggaccctgtcaatgttgagctgttaaaagaggctgtgatctcgctgaaaaacagcggtgtttctattttattttcaagccatcggatggaacatgtggaggagctttgtgagaacctttgcatattgcagaaaggaaaaccggttgtacaaggcaagctgaaggagatcaagcgttctttcggtaaaaagaatgttaccattcactccgatgacgatctgcgctttttgcagtcccatgaaggcattcttcaatggaaggaaacggcagacggtgtcaagctgcagattgccaatgaagacatttctcaagagatttttgctatgctccaaggaaaagggtttatcagaaagtttgagcttgaagagccgtcactgcatgatatttttatagaaaaggtgggggccgtctatgaataaattttggatcatgctttctcatacatacaaaaataagattatggcaaaatcctttattatttcgactgtcatcacggtgctgcttgttttagttgtaacaaatctggagtcgatcatttctttgtttcaaggtgacgatgcgaaagaaaaaatcgccgttgttgatgaaacaaacgaattatatccggttttttctaagcagctgaaagcggtggatacagacggcgattttgatgtgaagctgtcgaagcaatcggaggatgaggtcacaaagcaagtcaaagatgaatcactcgatggcatgctcatcatcaaacgagatgaaaaagggaccatttcaggaacatataaagcgttaacgatttctgatgaaagcacgtatcaaacgctgcagcaggcgctgacgcaaaccaaaacagctgtcggaacagcggagctcggcgtgtcgcaggaaacgattagcagcctttatgcgcccgttactgtggggcagaaggcgctgaaagaaggggcaaagtctgaggaagagcttggccagacggtagggcttgtttacattatgctgttcgttatttatttctcggtgattatgtatgccagcatgatagcgatggaggtcgcaaccgaaaaatcttcgcgagttatggaaatcctgatctcaagtatgccgccgatccagcaaatgtttgcaaagctgcttggtatcgggcttgtcgggatcacacagcttgctattattataggagccggctctctgtcgcttaagctgaaccaaaagagcgaaacggcttcatctgtcggcgggttccttaatttgaccgacgtatctgcaaccactgtcatctatgctgtcattttctttttgctcggatactttttgtacgcgacacttgccgcgtttctcggcagtgtcgtcagcagaatagaggacgtgcagcaaacgatcacgccgatgacgcttttggttgtcgccggttttatgatcgcgatgttcggtttgaatgcgcctgacgcaggatttattacggtaacttcgtttattccgttctttacgccaatgattatgttcctgcgcgtcggcatgcttgatattccgttctggcaggcggctgtcggaatcggaatcacactgctcaccattgtcatactggccgttatcggcgccagaatttataaaggcggtgtattaatttacggcaattcaagcgcgttcaaagcgatcaaacaagcgcttcgtttagcgaaaaactgattggaaaacagcctggggattctcaggctgtttctttattgacagaacgtgcattcgcaagaattcggtgctaaaataagggtacttcatcctggaaaggagcagaatgttgactgatctaacctttattcatgcggcagatcttcatcttgacagcccgttttacgggatatcgcatctgccggagccgatttttgcccggattaaagaaagcacgtttgcaagcgtgagacatatgatagacgccgcagtgagagagcacgttgatttcattttgcttgcgggagatctgtttgatgaagccaatcgaagcttaaaggctcagctctttttgaaaaaacagtttgaaagactcagagagtgcggaatttcggtatacgtcatctttgggaatcacgatcatcttggcggggagtggacgccgattgaatggcctgagaatgtccatattttttcgtccgctgttccagaagaaaaatcattttttaaagaaggcaggcgcatagcaagcatttacggcttcagctatcaggccagagcagtgatggaaaaccaagccgcccgctatcggagatcaactgatgcaccgtttcatatcggcatgctccacggcacgctgtcaggatctgaaggacacgatccgtattgcccgtttacacatgacgacctcgtgaaaagcgggatggattattgggcgcttggccatatacataaacgccaggttctatctgccgagcatccggcagtcatttacccgggaaacacgcaagcacgccatatgaaggagacgggagataaaggctattatctcgttcatgtgacaaacggagatatatcttatgaatttcagagagcgcacgatgtcctgtgggaaaaagcggcggttgatgtgacggaggcaaagaatatgaccgccctcttccaaatggtggagaacacgttttcgaggctgcggaaaaaggggagccctgtttgtgtaaggcttgttttacaagggacggcgccggaatggctgctggaggcgccaaaaggcaccttagatgagtttcttgaagctcttcaggagcaagaagcggaggaggaacgtttcgtttggcctcttagattggacgatgagacagaaaacgaagcaaacctaacaaaccttgatcctttttttggcggtttatttgaagacattgatcgcagcgatctgtcagacgtgctggaagggcttgagcggcatccagtgtatagaaggcacgcggaccggtttagccaagaggaagtaaaggaaataaaagagcaggcacagattttattgaaaaggcagcttaaggtgcttgatacatgaggcggtgacagctttgcgaattatatctttacatatctaccaatatggaaaattttccaatcggacctttcacttttccgcctctcctgtccaagtaatttacggattaaatgaggcaggaaaaacgacgatgatgtcatttattgaaagtatgctgttcggttttccaaaaacaaaaaaatatgaaccgaaaacaggcggtgtctacggcggtgttcttgaagctgaacatcctgaatatggggtgctgaagatcgaacggacgaaagggactgccgaaaaactaagcgtgtacacagaaaagggcgaagtaaagcagggagatgttttaaagcagctgttccagggcacagacaggtcgttgtacaaagccatatattcgtttgacgtattcgggctgcaggaaattcacgcctttaatcgggataagataggggaatttttgctcttttccagcttgtttggtgctgaagccgtatcaaagcttgattcaaggctgacgaaggaaagcgaaaggctctataaaccaaatgggcgaaaccctcaattgaatcaggagctggaaacgcttaagcagctggcagtgaagctaaaacaggctgaagcagaggaagcgggctatcatcagcttctcggggaaaaacgaacgcttgaagcccgccttgcagccgcggaaaccgaattgaaagagacggcgggacatatccgaatgattgagggagcgattgagcgaaaaccattgctaaatgaaaaagcgacactcgaacaggtgattgcagaatttccggaacatgcaggacaatttcctgctgacggactgcatcagctggaaaaatatgaatcccatctgcacccgaaatcagcacagcttgaggcgcttcgggtgaagatggcggagttggacaaacagaggcaaaagcttatccccaataaagaactattggcgaaagaaacgctgatacaagagctttcggcagggtttcatatgtaccaatcctggggagaacagctggccgccattcaggcacagctgcgccagacgtctgcgcagacagcggcagggctggaacagctcaataaaacggatgaaaatgagctcctgaatatgaacacctcatatgattatgaatggcagcttcagcaagcggtgcagcaatatgtacaggcaagagacagaaaacggcagcttgacgagacgtttgaacttgcccggcaagagctggaagacgtggaaaaggccgttcatgccgcttcgtccgcgattcttgaaaacagccaaagaaaagataaagaagcagctcttagagcatatgatgaaacacaggggcagcaccaagagcaagcgaagctcagagaacagctaacgttttttgaaagacagcaggctaaacagaaaaagactgtcattgtagctggtatgttgttcatcgttctcttttctctgctgcagcaatggattcccgccataagtttcggcgctgcacttattgtgtattggcttgtatcaggaaaaccgtcttctcgaaacagccgagagacaagacagcccatgacggatatttcaccagcagaagctgaaatgcttagagaagcgttatgggaggatgaccgcaataagcagcaccttctcacacagcgtgcagcgctccagcaaaaagaggcggcgtatgaaagggtcatccagcagtttgaacagtgggaagccgaaatggcgccgtcctttacacaggttgagcgttttatgaatgagctcggatttaaggaagatccatcatttttgcttgatgcatacagcttaatgaaggatgttaaaaaagaagtgaagaaaaagcatgagctgaccattgaagcaggcaggctgaaaaagcaccggagaacattcgaagaacgcgtcagtatgcttcgtcccgtgaatcagagtcaggatatctccatttcggacgcccttcacacattgcggaaaaacattgaacgtgaaaaagaaattgagaagcaaaaaaaggaaattgaaacagatattcattatacaaaggaacagatgcttgaacttgagcaagaaatacagtatttccacgcacagatcgaacagttatttgccgcggctgctgcaaaagacagagatgcgttttttgccatagccgacatcagcaggcaattgaaggatacggagaacaagcttcatcacgtaaacgcacagcttcaaggcggacacccggaggaacttgaactggcagattccaatacgctttctgaattgaaagataagcaatttgttgaaaatgaaagaaaagagcggctgactgaggagatcgagcggctccgcagccaaatcgcactgctctcagtcaaacaggaacaattagaggcctcgggattggtgtcagacctcaagcttcaaaccgaaatgcaaaaagaacgtgtaaaagaaacggctaaaaaatgggcctcgatacaaatgatcaaacaggtgatcagaaacaaattggagcggcataaaaaaatcgagcttccgcgccttctagagacggcaggagaattcttccgccctctgactgacggaaactaccaaaccatttatttttccgaaacggatgattcgatcatggttatgcatcgcgatggaactgtctatcatgcggaagagctgtcacaagggacctgtgaacagctgtatacagcgatccgatttgctttggccgttacgcgccaggatgggtcaaagcttccgttccagcttgacgacagttttgttcattttgatcaggaaaggctgaaacgtgtattacatgttctgtatgatttatctgaaggcggtaggcagattttgtattttacatgccatgagcacgtaaaagatgcatttcatagcagccaaatcatccatttggtgtcataaaagaggttctatagctgaaaatcggtatgtgatatactggtattatgtaagatacggagggagctttaatagaatggctaaagggattatgctacatgaggttggcgaacaggtggaccagtatctattgattaaatcctcgacgaaagggattgcaagcaatggaaaaccgtttttgacgctgatgctgcaagaccagtcaggcgatattgaagcgaagctgtgggatgccaagcaaagtgatgaagtgacctatgcgccgcagacgattgtcaaggtcgtcggcgatgttcaccattatcgcggacgcacccagctgaagctgagaaatatcagaccggtaagcgagcaagaaaacgtcaatattgatgattttttagaaaccgcgccgattccgaaaaatgaaatgatggacaccatcactcaatatatatttgaaatgaaaaatccgaatatccagcgaatcacaaggtttttggttaaaaaacacgaagctgagtttatggattatccggcggctacgaaaaaccaccatgagtttgtctcaggtttggcgtatcatgttgtctctatgctgaacctggcgaaagcaatagcagatttatatccgtctcttgatcgtgatctgctttatgccggtgtcatcctgcatgatcttggaaaagtgaaggagctgtccggccctgtttccacttcgtacacggttgaaggcaatttgctcggccatatttcaatcatggtgacagagctttcaaaagcggctgaggagcttcaaatcgattctgaagaggtgttaattcttcagcatttgattttgagtcaccacggcaaagcagaatggggcagcccgaaaccgccgatggtgaaagaagcggaaattcttcactatatagacaatctggatgcaaaaatgaatatgatggacagagcgcttgagcgcgtgaagcctggcgagtatactgaacgtgtatttgcactggaaaaccgttccttttataaaccgacatttcataaataacttaaaaaggactgatgctgacatattcagctcagtcctttttgatgcgtctttcccgcacataactcgtctcattcccgcatatggttaagaataaagaatctatgcaaagggggaggagcccgtgttattttttccatggtgggtgtatctttgtattgtaggcattattttcagcgcatataaacttgtggcggcagccaaagaggaagaaaaagtagaccaggcttttattgaaaaagaagggcagatttatatggagaggatggaaaaggagcgagaacgccgcagttctcagcagcatgaagaagaaaatcaaaaccattccatcgcataaaaaaagctgtgcggctcaatgagcctgcacagcttttttattatttggaactgcttgaagatgaagaagtgctgttgcttgttgaagatgtattaaatgtgtctttcagatctttatcttttacttcgatgtcagccttcttcatgactttttgaacagcttcctgaacggcattgctgtcatttagtttttgttcaagcacttcagatttcagttcttttttcatatcatcgtatttgccgcgttcttctgtctttttaatgatatggtagccgtattgcgttttgacagggtcactgacttcacctgtttttaatttgaatgcagctttgctgaatgtttcgtccatttggccttcttttgcaaaccagcctagatctccgccttgtgaagcagagctgtctgttgagtattctttcgcaaggtcttcaaacttctcgccttttttcagctttttctctacttcttcagctgtctttttatcagcgacaaggatgtggcttgcacggattttgccttttaagccttcccagtactctttgatatcggcgtctgttactttgatgttatctttagccgctttttgtgtcagcaattcatattttacttgttcttttaggtaatccttgccatattgcttttcgagggcagtatattgatcgccaagctgcgttttgtattctttcagcttgttgtcaatttctttatccgaaactttatacttcttgtccaatactttttcttgcactagctgtgtcagtacgcttgcgccagctgttttcttcatgtttgtgtaaagctcgccttttgtgacatcgcctgcgtctgtttttgcgatgacttctttgtcgccgctgctgcaagcactgagagcgaggatgcttgtagcagtgatagctgctattgcgattttcttcattgttttcaaacactcctaatcattccaaattaaattacctatgcgtatcataacatattgtggctttctgtaaaaagattttaaataaagggcattcgtctagtcaaacttttgctgatgacatacttatatattgatcaagaaaaggaggtatgtaacatgagcggaggatactctaacggattcgcgttgctcgtagtactgttcattttgcttatcatcgtaggtgcagcttacatctactaagcagcccgaggatcgcttgcaacataagcgatcctttattttcactagcgcctaatcgtttcaaacatgaattgcataacatgtaattggtaaataaagcttattacaggaggtgctttttaagatgggtgaagtatttgcaggcggattcgctttattggttgtgttatttattttattgattatcatcggcgcttcttggctgtactaatcaacataaaaagcatagctgcttaatcagcagctatgctttctttcgtatttacactgtaaaggagatctccacaaacgaagagatcagtaaaattaatatagatacattaataaatcggaataccttatcttgccgctcttcaggaatctctctgacaaggcataatgtattggtgagcctgtttatgaaatataaaataaacacggcagccacgataaaatagaataaaatgatgggagattcccctctctctgaactgtcccatattacattaccaaatatttattaaaaaagatagaatgcaaattgaaaaatcgccatcagcaccagggtttgactacttttcaacaagaatatccaagccgtctgcttcctgatcaataaaagcggttttcggtgcttttaccagcttgagagccagcaggaaatcaggcagacagtagccggcgtgaatgcccgagatcatgcagaaataatgagcatgattcggaaatgccagtgctgcgtaaaacaataccggtgtaattagcaagaacgggcttactagtgaaatgagcattgttgtttttggtatacgtttccatgtgcgcatgcgcaatatgtaaaactttttttctatttttctttttttgcagatgattggcaggacatggatgactttatgtacaaataaaataacgacgagcaaaccgccgaataaagatacatattcatcgcttaagcttgtgccaggccgcagcagctcaaaagctaaaaaggtagatataaaaaccaaaatcataaaacatacagcagttaatattatgcgaacggcgccataatccttcatgagatttatggtcttccagcaattcatcaaagtcatccttccatacatcttgaatagaatctcaaaataatttactcctcccaagagaaaaaatcaatgcttttttaagaaaaaatatcatccggcaggtatttttttgaaacaagcaaacaaactgcgaaatatggggttagaactttcttctcagtgaattatcagctaaaataagattaaagatagaaagaagtggtgtggatggattcgatggatcatcgcattgagcgattagaatattacatacaattattagtgaaaacagtagatatggacaggtaccccttctatgcgcttctcattgataaagggctgagcaaggaagaaggggaagcggttatgaggatatgcgatgaattgtcggaagagctggcaacacaaaaagcgcaaggatttgtaacctttgataagctccttgcgctttttgccggacagctgaatgaaaaattagatgttcatgaaacgatttttgccctgtatgagcaggggctttatcaagagctgatggaagtctttatcgacatcatgaagcattttgattaactgtttacaggttcaagctcttcagccggttcatccgccgcactgtcctttgcttttttcttcagttttccgtttacgctttcaaagtcattgtcaatattggtgagtgacgtttcgaaaatttccataaaatcatcgccgtagatatggcgtatcatacacatcatttctgccacttcaggaaattttccgaataaatgatacaaaggctgtgaccctttaaaaacagcgttgcgtgtcggatcaaattcctcaagcaagctccagaatacctcggtaccttcctcagtcaattggacatatgtgttccgtttatcattcagccgtttggagaaccttaaatatccccgttcttccagcttttttgaaaagttgaatgcggttgatacgtgcatgaccccgaacttcgcgatttcagaaatggaagctccattcaattgatacgcaatccataaaatatgatgctcattaatattcaggtcatacggtttgagccattgctgccaatccttctcgattgatttccaaagagccttgctaagctgagccattttctgggtgaagactagagcttctttcacatcatagggcggttccactcgattcattacgtcacctgcttctctttttctttttctctattatgccaataaaataaagattaataaagatgaaaatgtaagaattttttaataaattcacaaaccattgcgacgaaagggtttttcggccaaaaaaaatacgggtccaattttggcccgcatttttttcttttgaataggatattagttttgtaaggttttctccagctgtctgattttctcttcgatatcggcaatttctttttgcagatcctgctggtgaggcttgatctcttcctgccattttttaattgacgtttggagctcgccgcccacgtctttaataacatccgtgctttcttttgccgctttgatcagctggtcttttaatgcaagcccgtctgactttaagcgtttgattgtttcttcaaaagaatcataattggttttcattttttcacgcagctgctttcctgaggaaggtgcagtaagaagaaccgctgctcctccgatgatgccgcctacgaatagtcctgttaatagagaacgtccgctcgccattacaatcaccccgtctttttcttcaaaataggattcattcagcatttttcatttttgttgaaatcctgaacttctatacatagcttgctttattttagcatattttttaagtgaaaaggagggagaaggttgtctgtctttttgattgtattatcctgcatcacacttgccttcgcttcaggcgctgtttactatatcagacttctcagccaggctgcttcttatccgcccaagagggttatccggcagaaagcgcttgtttgttcaaccggaaccgcctttacactatgtcttatctttttcacaaaactcctcgcttaaaacatgctgacatgctgcgggcgctctgttcaaaaaaacctctcccggaagcggaagaggttttgtgtgacaattatttagcagcttccataaagcttgaacgccttaaaatggtttgcacaatcggataaataatgatcattgagattgtattcagcacagcggccggcagaacaacagccgcgaacaatgcagcgaaaccgccaggcaaaccgacgatcaataaagctgacgatagaaacacaattcctgataagatggtcccgatcactgtcagcacagcggctgcacctgtttttcggctctttctgaacaagagaaacagggagaagaacagaaacgctgatacgggtttatcaatgatgttagggatctgtccggctggaaacgcggttgtaagcgcggaaatgattccggtcacaatcccgatgacgagtacattttgcacccgcgggaacagcagaatgcccatgaacatcatgatcagcatcatatctggtttcatgccgcctaaaaagggcggaataatggaatgaagcgctgcgccgattgcggcaaacagagccataatgactaactcttttgttttcataactatgctctcctctgctaagctttttgccctccaataatatgctcatcatttattgcgaaggctttacagaatgtattatgcaaacagtataccaaacggacggtttgcatagccagactttttactcattttcctgctggaatttcttcatgaacgcagctaatttttcacagtcttcgagagagaccgcgttataaatagaagcgcggcagcctccaaccgaacggtgtccgccaaggccgatcatcttcgcatcttttgctttctggacgaatgttttcgttaattcgtcatcccgaagcgtgaaggtgacattcatgcgtgagcggctgtcctttctggcatgtcctttatagaagccgttgctttcatcaatacagctgtagagaacctgcgctttttgttcattgcgctgttcaacagcttccacaccgccgttttccttgagccattccagaacgaggctcagcatataaatcgcaaatgtcggcggagtgttgtagagtgaatccgctttgacatgtgtggaatatttcaggatttttgggacgttcgcattttcatttttcagccagttttttttcataatgactacagtcacgccggaagggccgaggttcttttgggcgcctccgtagatcacatcaaatttggacacatcgatttttctgcttaaaatatcgctggacatgtcggctacgagcggaataggagaattcggaaactcctgccactgagtgccgaaaattgtattgttggatgtgatatgtaaatatgcgccgtcttttacatccgtaaggtcaacctcaggaatatagctgtaattgtctgtttcacttgtagcggtgatagacgtgttcccgaacaatttcgtttctgccagtgctttttcagaccaagcgcctgtcatgacaaaatgtgcggttttttcaggtgttaaaaagttcatcggaagcattgagaattgaaggcttgccccgccttgaagaaacaagatatcgtaatcttccggaatgcccatcagttcgattaagaggcttttcgctttttggtgcaccgcttcatactctttgctgcggtgggaaagctccataacagacatgccggattcgttaaaatcaataaattctttctgtgctttttgcagaacttccagtggaagcgctgcaggacctgcgttaaaattcgttgtacgttccattatgatctctccctgttttccacgttaatgtataaaataatacaattatcctatcacaaaaattcagttttttgataaaaaattagaattatcaaaagaaattgacggatgtttgcgaaatgttcacaaaataaaataacctcatcttatgatgaggccaggcgttttgcgatagaggaagagatgttctgcagatcctccggtttataatcatcagcatgcgttttccaaaccgctccgaatccatctccttttccgtagcgagggataatatgcatatggtagtggaacacagattgtccagctttttcgccgttattgttcagcgtatttaagccgatcggttcaaattcatcccggatagcgcgggcgatttttggaacagcatggaaatattgttttgctaattcatctgtaaattcatatacattctcaatatgtgttttcggaatgacaagcgtatggccttttgtcacttggctgatatcaagaaaggcaagtacatgttcatcttcatacaccttcgcggatggaatgtcgccggcaataattttacaaaagatacaattctctgcacaatgcatgagggttcctccttatgaaattgtttagtatgtatacattcatcgtaccacagaaatgcagaaaatagaaaacaggatgaacggcgagcgttcaccctgaatgcagaggaagagcttatatgaagaaaatgtgttatgcctttggtaagcacctcatttgtcaataaaatgaagacttgtttaatgcctaacgattcctgcgataaacacctcatttgacaatgcttcatacatgaagaattcatcaattcagtgaagagaaatggtttgagcattggacatgtttattttctatccaactgtttctaagacgtctttgacaaacacctcatttttcagttgatatgcttttcctctacaactattatgatgtccagaacctgtctctttatgacagcaaattcatcatttgttaaaagggaattgtttcaaatcaggccttgtttttggtactatgaagaaaaacactataaggggagaaactatgtctctgctatcggtaaaagacttgaccggcggatatacaaggaatccggttttaaaaagcgtatcattcacccttgaaccgaatcaaattgtcggcttaatcgggctgaatggtgctggtaaaagtacaacaatcagacatatcatcgggctgatggacccgcataaaggttcaatcgaattaaacggtaaaacgtttgctgaggatccggaaggctaccgttcacaatttacctatatacctgaaacacctgttttatacgaagaattgacgctgatggagcatcttgaactaacagccatggcatatggactgtcaaaagaaacgatggagaaaaggctgcctccgcttttaaaggaattccgaatggaaaagaggctgaagtggttcccggcccatttttctaaaggaatgaagcagaaggttatgattatgtgcgcatttttggcagagcctgcgctctacattattgatgagccttttctagggcttgatccgcttgccattaacgcgctgcttgaacggatgaatgaagcgaaaaaaggcggggcgagcgtgctgatgtcaacacacattttggcaacggcagaacgctattgcgattcgtttattattttacataacggcgaggtgcgggcgcgcggcacgctgtcagagctcagagagcagtttggaatgaaggacgcggcgctggacgatttgtatcttgagcttacaaaggaagacgctggccatgaataatatgcttgatatttggcagtcgcggctgcaggagcatatcaaagaaacaagaacatacatgaaatatatgctcaacgatcacctcgtcattgttttgattttttttctagcgggcgctgcaagctggtacagcaaatggatacgggacattcccgctcactttccgtccttttgggtgatggccgtgctgttttcgctcgtgttgacaagctcttatgtgcgaacgcttttgaaggaggctgaccttgttttcttattgcctcttgaagcaaaaatggagccttacttgaagcaggcgtttgtctacagctatgtgtctcagctgtttccgcttattgcgctgagtatcgttgcgatgccgctttatttcgaagtcacaccgggggcttcgctcgtatcgtatgccgcggtctttgtccaactgttgctgctgaaagcgtggaatcaggtaatggaatggcgcatgactttccaaaacgaccgcagcatgaaacggatggatgtcatcattcgctttgcggcgaatacactcgttctttattttgttttccaatctgtttatatgtatgcgcttctcgtctatgtcattatggctgttctttatctgtatatgtcttccgcagcaaaacaaaaaacatttaaatgggagagccatattgagtccgaattgagacgaaagcagcgtttctatcggattgccaacctgtttactgatgtgccgcatttgcgaaagcaagccaaacgcagagcttatctcgactttttgctgcggctcgtgccgtttgaacagcgcaaaacatttgcctatatgttcacccgcgcctttttgcgttcgagtgattatttgggcattcttgtcagattaacgatcgttttcgcgctgatcattatgtatatctcagccagcccgctgattgccgcggttttgactgtgtttgccattttcattacgggcattcagcttctgccgctcttcggccactttgaccatctggcgcttcaagagctgtaccctgtgaaaaaagaaacaaagctgaaaagctatttctctctattaaaaactgcacttagtattcaagcgatgctgatgtctgttgcatctgcctatgcagccggcttgaccggttttctgtacgcgctgatcggttctgccgttctgatttttgttgttttgcctgcttatatgacaaccaggctgaaaaagcacggaaagctgtgaactgaaaagaggtaatcaaatgacagataatcagctgctgatgcaggaagctttggaatggaaaatgcattttttgcgaaaggattccatgtttgaacgcttttcgaagcgtgtccagacgaaggtgaatgaacggattcctgaaaaaatccatacggtcgtcaccgagagtgtgagaaaaatggtagaagcgacaatggccggctccaatatcatcacttataaaaaggatacaagtgcactgtcgctcagtgaaaaaaatgaattggcgaaaaaaacgattgtttcttatcagaaagtggcagctgctgagggagtcggcaccggagcgggcggcatttttttaggcattgctgattttccgctgctgctttcaattaagatgaagtgtttatttaccttgtcttccatttacggctttaatgtcaaggatgcacaagaaaggatgtttttgctgctcgtgtttcagcttgcgttttcgagtgatgatggccgtaaatcgcttttttctgtcatcgaaaattgggagacggagaaaaagagcatcgactggagagtgttccagcaggaatatcgcgattatatcgacgtcgtgaagctttttcagcttttgccgggcgtaggagcggcagtcggcggaattgccaattataagctgcttgctcagcttggagaaacggcaagacatgtttttcatctgaggatattaaaggaaacagccggagaataaacactccggctgtttttttatagctgatgataggtgatcgcagcgccggcaaggaccttggccgctgtcagcatggctttttcgttgatatcaaatttcggatggtggtgggaataaactcggtctggctgttcgggagcggcacctgtaaagaaaaaagtgcctttcacgttttgtaggtaataagcaaaatcctcgccgcccatttgcggttcaccgtcaatgacctgctgaacgccctcggtattctttgcggtgctcaccaagtggctcgtttctgcaggatggttcacaaccgccggataaccctgttcataggtgtactcataggacgcgccgtgcatgctgcatattccttttacaactgcttcaatttctttctccagaatgtcccggacattttcatcaaaagaacgcgctgtgccgatgagtactgcttggtctgcgatgacattaaacggattgtcggcgatgaaggagcctgtcgaaatgacggcggattgaatcggattgactttgcggctgacaatgtgctgcaaagaggtaacgatttgagaaccgattaggacggcgtctttagtatcatgcggatgagcgccgtggccgccctttccgaagactttaatcgtaaatcggtccgccgccgccattacggcgccggggcggcaaagaatagttccgagcggctcagttgcccaaagatgagtgccgaatatcacatccgcgttttcgagacagccgtcatcaatcattggctttgcgcctcccggataatattcttctgcatgctggtggatcatcacaaatgttcccttcagttcatgtctgttttggtgaaggaccttggccactgcgagaagagctgcggtgtggccgtcgtggccgcatgcatgcatgacaccaggcactttggaggcgtaagggacatctttttcatcttgaatggggagagcgtcaaagtcggccctcaaagcgactgtagggctgggttcgcttccttctatatatgctaaaacccctctgccgccaacgtttgtgcggattgggactcctaacgattcataataggaagcaataaatgcggcggttttttcttcttgaaatgagagctcaggatacatatgaaaatggcgcctgatctcaaccatttcttcaaaacagccctcgagctgtttgtttatctctttctgcagtgtggatatggacaaagccgcttcccccttttctatgcttttccatgattgtatagaaaaagtctgaatatttcaactcatgctgtttcaaagcatcatcacagctgcgagggttgtcaccaaaaggccaatcgcgacgggaatgaagttttttctggcaagctcaaaaggatcaactttgcaaatggccgcggcgggaatcaacgcccatgggaccagtgtgcctccgcccacccagatggcagagatttgtccgagcgcggtcagaacggcgggatcggcatggagagcggacgaaaagagctttgcgatggagccggcgagagaaatgccagaaaatcctgagccgtcaaggcctgttatggctccagcggcagttaatgcagcggtggcaagctcctttgacataggcatcatatgggataaagcaatgccgagatcgttgacaatgccgtgggaacctttagggagtgaagtgcccagtatgctctcatagcctgagtcgccaagataaaagaaagcggcaatcgggatgacggggccgaaaaccttaaaaccgaacttaaatccgtcaataaaatagccggtgattttttcaagccctttatgcttatacacgaaaaaatgaacggtaaggaggatacagattgcagacccgccaattaacgcggtggcatcatttccttgtaggttaaacaagagcatgcaggcaatatctgcaagaaaggcaagcggaatcaaaaaagccagtatggaccgcaggcgttttggcaagtacagcgagttgtcttgttcaccggaaagaacgggggaaaaagaagctggaggctcctgttttttgcgttcgcgctgaatcatgataaaggcagcggttgttgttgtcacacccataatcagcacaagcggaatgctggccgagacgacatcaccgactggaatgcctgctgcatccgcagtcagctttggcgccgcttgaatgacaaagtctcctgacagggcaaaaccgtgtccgaataagttcatggccatagccgcggcaagaggcgtcaaaccggcacgtgcggctgcggggagcaggacggcgccgatcaaagcgacacctggagaaggccagaagaagagagaaatggcgaacatcaggcctccaatcagccaataggcagtcacaggccctctcacaaggcttgcaaagggagaaatcatcgcttcatttatccctgtttttgttaacaaatcactcatcgaaacgataaagcaaatgatgaaaatcgtgggcagcagttcgccggccgcatagataaagctgtggaataaactgctgacagaagctgaaagtgaatggctggcccatagcgatatgataaaaatgccgaatagagaaataaatgtcgtgtcttttctcagcagcataaataggataattgctccgataaaaaacacatacagaacatggacagacaaaatcccgacttccatcatcgatcactccttccgcttacagattattcataggcgggcggaaggtgccgggacagaggggagggttatgatggaagatgaacattgatctgtttcagctgctcaatcagatgatgccttaatactctattcgctttttgcagatgttttgggaagcattcaggagaaaaaatgatgcacaattcagcaaaccagttttttctataggcgatgatgctttccgatggttctaaatatgaaccatcctcgtgctgcatctcgtaatcagcaaattcgaactgaaaaccgcagcacgggcagatttcatgagaatgattgccttcatgatcatatggcggttcagccaatcccttaaacccgcagactgggcaagtatgcttcattttgctttcctcccaataaaataagctgccggacatgccggcagctattcgacagcgaaatatgtggtgacataggaaggccgggagaagatcgacgttgtgtcaattccggcagatgtatcgcgttttttgtgggcttctttgtaagaaccggactgctgccagtcttgaaaggcgctttccgtttcccacaaggtcagaatgacataggtgtcactgtcaagcggacggagcactcgaattgcttcaaagccaggctcattttcgacttttcccgctctgtttttaaatctgttttcaaacagcggacgcccttcctgagtgacggcaatattgttcaatactgcaaaaccgggatgcttgatctctccgacttggtcaatgacttcataagcgtgtggtgcctggaaaacggtttctccgtttgtttcatgaatcaaaatggcgttttcctgcccctgcatcaaaaggatattttctgagggatacttttctacgattgtttttaaaaaatcggctgtcccatatgtaatataaaccttcatatcagccacctcctgcttgctagtatatcaaaacaatggtataagtttctattggcgagtgcttcgaacataattccaaacaatttttcccatactacctttagaaaggcgaggtgagttcatgtttaagataaagaaaaagaaactttttatacctatcattattttagtgttaactgcttttctcgctttaataggatatatttcaattatttttctcggccattatgtcatagatgaaaaaaagcttattcttcatgcttcttcaaaaattgttgatcaaaacggagatgaggttgcaagcctgtatacagaaaatcgcgagccggtctcgatcaatgagattccaaagcaggtcagagaagcgtttatcgctgttgaggataaaagattctatgagcatcacggcattgatgcaaaatctgtcggaagggcagtgtatcgcgatatattagcaggcggaaaggtggaaggcggaagcacaatcacccagcagcttgccaaaaatatttttctgacacatgacaaaacgtttctaagaaaaacaaaagaagtgatcattgcgattaatcttgaacgggattacagcaaggacaagctgcttgaaatgtatttaaaccagctttacttcggacatggggtttacggcatacaagcggcgtcccactattattttaataaagaagtaaaagatttgactgtatctgaaggcgctgttttggccgctattccgaaggcgccttctacgtactctccgattttgcatcctgataaaaataaggagcggcgtgatacaattctaggtatgatgaatgaccaaggctatattagtgcgaaagaggctgtcaccgcgcagggccggacgcttggattgcacgtgaagaaacagtcggaaacaccttggtttgacagctacattgaccttgtgatcaaagaggcggaagacaagtattccatttccggagagcagcttcttcaaggaggatatacgatcaaggtgccgctcgattcgaagctgcagaagacggcttaccaggtgatgaaagagggaagctattatcccggaacagatcagaatgccgagggaagcgcggtctttattaataacaagacaggcggtgtagaagcggccatcggcggaagggattacacatccaaaggatataaccgtgtcacagctgtccgccagccgggttccacatttaagccgcttgccgtatacggaccggcgatgcaggaaaagaaatttaagccgtattctctattgaaggatgagttgcagtcctacggagattatacgccgaaaaactacgacagccggtatgagggcgaagtcactatgtctgacgccattacgtacagcaaaaacgcgccggctgtctggacgctgaatgagatcggcgttgaaacaggaaaatcttatttgaaagcaaacggcattgatatccctgatgaaggccttgctcttgctctaggcggcttggaaaaaggcgtttcaccgctccagcttgcgggagcatttcatacatttgccgcgaacggaacgtatactgaacccttctttatctcaagcataatagatgaagacggagaaacaatagccgatcataaagaagaaggaaagcgggtattcagcaagcagacgtcttggtatatgacgagaatgctgcagcaggtagtcaaaaagggaacggctacgtccggcacctatcacggcgacctggcgggaaaaacaggttctacatcttatacaggcgtctccggcgcgacaaaggacgcctggtttgcaggctatacgccgaaaataaccggggcagtctggatgggctatgacaaaacggatcaaagccattatttgaaagccgggagctcatacccgacgcggctgtttaaggatattttgacacaggcaggagaaaccggtcatgtgttcacaaagcctaaaaacgttaaagaactggaaagcccgattgagctgaagccggtcaaaacactcacagccgattacacatttaaagcagcggggctctttactattgaattaaagtgggacgctcaagaggatgatcgggccgtatacagaatttatgtaaacaaggacggcaaggagacgcttcttgattcggttgaagggaagggaagctatgaaattccttatgccaacttattttcgggcgcgtcttataaaattgtgccttataatacacagacaaaaagagaaggggaaggaaccgattacgttcagccaaaattgttttcctcttaatggaattcggcgattttttgaactttgagctacatttctataccatttgcctaaaacaaggtatagtgtaataagtcaagaaatacgaacgtatggttgccgtatgaaaggtggaaatcagatgagtaaacgagaaacgtttaacgagacgtttttaaaagctgcgcggggagaaaaagcggatcacacgcctgtgtggtatatgaggcaagcagggcgctcacagccggaataccgcaagctgaaggaaaagtacggattgtttgagatcacacatcagcccgaactttgtgcgtatgtcacaagactgccggttgagcaatacggagtcgatgctgcaatcctttataaagatatcatgacgccgctgccgtcaatcggtgtggatgttgaaatcaaaaacgggatcggtcctgtgattgatcagccaatccggtctctggcggacattgaaaaactcggccaaattgatccggaacaggacgtgccgtacgtgcttgagacaattaaactgcttgtcaatgagcagctgaacgtcccgctcatcggtttctcaggtgctccttttacgcttgcaagctatatgatcgaaggcggcccgtcgaaaaactacaataaaacaaaagccttcatgtacagcatgccggatgcatggaatctgctgatgtccaagcttgccgacatgatcatcgtgtacgtgaaagcgcagattaaggcaggcgcaaaagcgattcaaatctttgattcgtgggtcggcgcattgaatcaggcagattacagaacatacattaaacccgtaatgaaccggattttttcagagctcgcaaaggagaatgtgccgctgatcatgtttggcgtcggcgcgagtcatctcgcaaatgattggcatgaccttcctctcgatgttgtcgggcttgactggagactcggcattgatgaagccagatcaaaaggaatcactaaaacagtgcagggcaacctggacccgtccattttgcttgcgccatgggaagtcattgagaagaaaacgaaggaaatacttgatcagggtatgaaatcagacggcttcattttcaatcttggccatggggtatttcctgatgtcagtcccgaggttttgaaaaaactgacagcgtttgtccatgaatattcacaaaacaaaaaaatgggtcaatattcctaagcatatcttttggtatcttaatgatatcctgtcaaaatgtttgtatcagatcattaaagagggtgtaaacagtgagtagaaagaaaatggggcttctcgttatggcgtacggcacgccttataaggaagaagatattgaacgttattatacacatatcagaagaggcagaaagcctgaacctgaaatgcttcaagatttgaaagacagatacgaagcgattggcggcatttcaccgcttgccaaaatcacagaagagcaggcgcataatctggaacagcacttgaatgaaattcaggatgagattacgtttaaagcgtatatcggactgaagcatatcgagccgtttattgaagacgccgtagcagagatgcataaggatggcattacagaagcagtcagcatcgtgctggcgccgcatttctccacgttcagcgttcagtcctacaacaaacgtgccaaagaagaggctgaaaaacttggcggcttaacgattacgtcagttgaaagctggtacgatgaaccgaagttcgtgacatattgggttgaccgagtgaaggaaacatatgcgtcaatgcctgaggatgaaagagaaaacgcgatgctcatcgtatccgcacacagcctgccggaaaaaatcaaagaatttggagacccgtacccggaccagctgcatgaatcggcgaaattgattgctgaaggcgcaggcgtttccgaatatgctgtcggctggcaaagtgaagggaacacgcctgatccttggctcggacccgatgttcaggatttaacacgtgatttattcgaacaaaaaggctatcaagcatttgtatatgttcctgttggatttgtcgcggatcacttagaagtgctttatgataatgattatgaatgcaaagtggttactgccgatatcggcgcaagctattaccggccggaaatgccaaatgccaagcctgaatttattgatgctttggcaacagtcgtattaaaaaaattaggacgttaaagaaggcgatgaacatgagtgacggcaaaaaacatgtagtcatcatcggcggcggcattaccggtttagccgccgccttctatatggaaaaagaaatcaaagaaaagaatctgccgcttgagctgacacttgttgaggcaagtccgagagtcggcgggaaaatccagactgtcaagaaagacggctatatcatcgaaagagggccagactcatttctggaacgaaagaaaagcgccccgcagcttgttaaagacttaggtcttgagcatttgcttgtcaacaatgcgaccggacaatcctatgtgcttgtaaaccgcaccctgcatccaatgccgaagggcgctgtaatggggataccgacaaaaattgcgccgtttgtttctacgggtctgttttctttgtctgggaaggcgagagctgctatggatttcatcctgcctgcaagcaaaacaaaggatgatcagtcattgggagaattcttccgcagacgtgtcggagatgaagtggtcgagaacttaatcgagccgcttctatcagggatctacgcaggcgacattgacaagctcagcctgatgtcgacattcccgcaattttaccagacggaacaaaagcatagaagcctgattctcggcatgaaaaaaacaaggcctcaaggctcaggccagcagctgacggcaaaaaaacaagggcagttccagactctgtcaaccggtttgcagacccttgtagaagagatcgaaaagcagttaaagctgacgaaggtgtataaaggcacaaaagtgaccaaactcagccgtggcggctctggctattcgctcgaactggataacggcgtcacacttgatgctgattcagtaattgtgactgctccgcataaagcggctgcgggaatgctttctgagcttcctgccatttctcatttgaaaaatatgcactccacatccgtggcaaacgtcgctttaggtttccctgaaggctccgtccaaatggagcatgagggcacgggttttgtcatttcaagaaacagtgactttgcgatcacagcctgtacgtggacgaataaaaaatggccgcacgcagcgccggaaggcaaaacgctgcttcgggcatatgttggaaaagccggagacgaatccattgtcgatctatcagataatgacattatcaacattgtgttagaagacttaaagaaagtcatgaacataaacggcgtgccggaaatgacatgtgtcacccgatggcatgaaagcatgccgcagtaccatgtcggccataagcagcgtatcaaggagctgcgtgaagcacttgcatctgcatatccaggtgtttatatgacaggcgcttctttcgaaggtgtcggcattcccgactgcattgatcaaggaaaagctgccgtgtctgacgcgcttacctatttattcagctaaaacctccgctttatcgcggaggtttttttgatgtgcaatggcaatattgtgtaaaaaaatgattgaattgaacagcaggttatgatacatttgcatatgtacttaatgactaaaatgttcaaacggtcagtttcgaggtgaatacaatgtcaatagatcgaaaaaagctcattttggaggcggctacaaagtctttcacgcagttcgggtataaagcgacgacaatggatcttgtcgcaaaacttgcgaacgtggggaagggaaccatttatacttttttcaaaaacaaagaagagctgtttgacgagattttcactactttattaaaggaaatgaagcaaaaagcggatgaagcgatggagccgaaccttccgttccatgaaaatgtgcacagagcgctgtttgccattctggagttcaggaaaacacatcagctgacgattaaaattttccaagagaatgccgagattggtacaatggcagttcaggaagtgatccagaaaatggagcgagccatactgtcttatatcaaaagcaagattgaagacgggatcaaaagcggcgcaatcaagccgtgcgaccctgaactgacagcctttgtgatgctgaagctttatatcgcgctcatttttgactgggaaaaacaacaccccccgcttgataaagagacaattgcgggactgcttgaattgtatgttgtcaaaggattgtcagcgaactagataatcctttctctttgcaagaaaatgaccatttttcatgatgagtcagttttagaatggaggcatcaggatgaacacaatacgaagtcagtggaaagacatcgtaacaagtaaaaaattattgattcccatcatcgccattttgtttgtcccgcttatttacagcggcgtattcttaaaggcttattgggacccgtacggcacagttgaccagctgcctgtcgttgtcgtcaaccaagacaagggagcaacgtatgaaggagaaaaacttcaaatcggtgatgatctggtcaaagaattaaaggataataacaactttgattggcatttttccaatgatctcgaccaatcgttaaaggacttattgaatcaaaaatattatttagttgtcgagattcctgaggatttttctaagaatgccagcactgtattagacaaaaatccgaaaaaattggatctgaaataccacacaaatgcaggttctaactatgtaggggcaacgatcggcgaaaaagcgattgataaactgaaagcctctgtttcaaaagaagtgaccgagcaatatacgaaagttatttttgataactttaaagatatcgcaaaaggtttgagcgacgcgagcagcggcgcgaaaaaaattgatgacggcacaaaggatgcgaaaaacggaagcgcccagctgaaagaaaatctggcgaagctgaaggaaagcaccgctaccatcagtgacaaaacagcgcagcttgcagatggagcggctcaggtgacgagcggcatccaatcgcttgacagctcgctcggtaaattccaggacagcagcaaccagatttatgataaatctggccagcttgcagcaggatcaggcaagataacgggcaagctgaatgaactgaatgccggccttcaaaaggtgcagcagggcttgcctaatctgacaaacgggctggatcagctcaacagtaaagcgcaagaaggttctgagaaagcagcaaaagcggaaaaacttataaatgcgctcgatttaacgaagcttgaaacagctgtgaataacctcgaaaagtcagaaacagcgatgaatgaatttaaaaaacagctgtctgactttgaaaacagcttaaaaaaccgtgatcaggcatttaaaaatatcatcaactccagtgatttcttaacagcggagcaaaagagccagctgatcagctctgttgaaaagcagcttccgaaagttgatgcgcctgattttgatgaaattttaagtgggcttcctgcagctgatcagctgcctgacatcgcaacgataaaaagctcattggaagacgtgaaagcgcaggttgcccaggtgaaggcattgccggaagctacctctaagctttataacggtgcaaaagccactcaagacgcgattgacaaattaactgctggatctgagaagatatacaatggttcacagcagctgacagaaaaccaaaataaactgacagcgggtatcggtgaatataataagcagttcgcaaaagcaaaagcgggctcagagcaattggtgacaggaagcagccaagtatccggcggattgtttaagctgttagacgggtctaaacaggtccaaagcggatcatcaaaactggcagacggatctgcatcacttgatacaggtttaggcaagctattggacggcacaggagagctgtctagtaagctgaaggatgcggctgaccaaacaggagatatcgatgctgatgatcaaacatatggcatgtttgcggatccagttaaaaccaaagatgatgccattcattccgttcctaactacggtacagggctgacaccttatatcctgtcaatgggcttatatgtcggcggcatcatgctgacggttgtcttcccgctgaaggaagcgtcgggacgtccgagaaacggttttgagtggttcttcagcaaattcaatgtcatgatgcttgtaggaatcattcaatcattgattgtggcgacggttcttctattgggaattggtctcgaggtagagagcacgtggagattttacgtgtttacgatcattacgagtctagcttttctagcgataattcaatttttggctacaacgatgggcaacccgggacgatttatcgcagtcattattttagtgctgcagctgggagcgagcggaggaaccttcccgcttgaattgcttccgcatttctatcaggtcatccatggcgcattgccgatgacctacagcattaacggattcagagcagtcatttcaaacggtgactttggctacatgtggcagatggccggcgtcttaatcggcatcgccctcgtcatgattgcactaagcattacttactttacaatgttaagccggaaggaagaaacatcagaagaacagccggcttcataaagaaaaagaacttgtttccttggaaacaagttctttttttgttacattccccatttaataagcaatcctgtataggttaatccgccgccaaacccgaaaagcaaaacgatttgatcttttttcagcttcccggctttcactgcgagatcaagcgccaaaacaattgaaaccgaagatgtgtttccgtagtgctcaacactagtgagcgttttttcaatcgggaacggtgttttttcacaaattgactcgatcatgcgcaagttcgcgctgtgaggaacaaaccaatcgagatcatcagagctgagtcctactttatgtaaaagccgttcaaattcgccagggacagttcttgcggcccatttatatacctcgcgtccattttgcaccatttttccagaaccgacaagctgcacaccgtttatttcatttcgcagtccggcacgatacaaaatatcgccgccgttcccgcttgttccttgtacagacgcaagaaatcccggcgtttcttcatctcgttctactaacagcgcacccgcggcatcgccgaacagtacgcatgtcgttcgatcggtataatcggttacctttgataacgtctctccggcgatgacgagaattttttgatgaaggccagatgtgatcaatccatttgccaaatggaggccgtatgtcagcccggcgcatgtcgcattaatatccagcgcgccggtgctttcccagccgaaatattcctgtacgcggcatgccgtactcggaaaggcgtaatcggatgtggttgtggcaacgaggatcatatcgacatcatcaagtgttcctttataacggctcttgagattcttcaccgcttcgatgcataaatcagaggtaaattgatgttcatccgcaatccggcgttctctcattcctgtgcgctgaacgatccattcatcagaggtatcaacgatcttttctaaatctgcattggttaagcgtctgctcggcgcataggtgccgatagctgtaatttttgcttttgacatatgaatcactccttatggtcagattataacactagatattagtatctggtactaaaaagaaggtttttttacaaaaaaagagaagtgtagaatagggaatctatgaaaaagaaaaaggaggctgaaaaatggtcagtcaagaagcagtagtctttttggcattatccggggctattgcgtttctgttgccaatcgggctgattgtatggtttaagcgaaagtatggcgcctcgcttaaagtgttttttattggcgctctcacgttttttgtcttcgcacagctgctggaaggcggcgttcatgtttatgtactgcaagtgaatgaaatgacgaaagaagcgatgcaacatccattatggtatggcatttacggctgcttgatggcgggaatttttgaggagtgcggaaggtatatgatgatgcgattttttatgaagcgccatcatacttgggcagatggtctggctttcggggcaggccatggcgggcttgaagccatcctgattacaggcttgtcctctatctcacttattgtatatgcatttgctatcaatagcgggacgtttgaacagcttttggtcaatggcgacatcaaacaggcgcttttgccgatacaagagcagctgctgcatactccttcgtatgaatggatgctgggcggaatagaaagaatcagtgccattgccgtccaaattggtctgtctctgcttgttttgtacgcggttaaaaaccgccggccgctgtttttgttgtattctattcttttacatgcactgtttaatgtaccggcggttttatatcaaagaggaatcatagagcatgctgctgctgttgaaatcattgttgctcttatagcggctttatcagtttattggattgtaaaagcaaaaagggtgtttcaataaaaggtccaagcagcagcaatgcccgcttggaaaaatgtgaatggaaatattcattaagcatgggttatcagaatatttctgattcagtctttagcaatgacagcaagaatgtctgtgttttttacaagagaaacaatggtgtttctttttcttcttctcgcaagggtcatggcattctttctttttcttgcaatggtcgtggaaatctttatcgaaccactcgtcaaagaaccaaaaatcatcgaaccaatcgtgacaacgacatttctgttcatgtgaatgacgacagcacatagaaatccctcctcttcccatgctctctacagcatatgagagattgataggaaaagattggacgggtccctcgggaaaagagtatattttaagtagaaaataaaaggaggaatgccctatgacgtccgtacgtaaaacgatggagctcattaaagaacttgtatcgatcccaagcccgacaggaaatacatatgaggtgatcaattatattgaaagccttttaaaagaatggaaggtagaaacggttcggaaccacaagggcggcttaattgcaacgcttccaggacgcgacacatcccggcatcgcatgctgacagcgcacgttgacaccctcggcgctatggtgaaggagattaaagcggacggccggctgaaaatcgacttaatcggcgggttccgctacaactcgattgagggggagtattgccaaattgaaaccgcctcgggaaaaacgtacacaggcaccattttaatgcatcaaacgtctgtgcacgtatacaaagacgcgggaaaggctgagcggaatcaagagaatatggagatccgcctagatgaaccagttcactgccggaaagatacggaggagctgggcattggtgtcggagattttgtgtcgtttgatccccgtgtcgagatcacatcaagcggatttattaaatcgcgccatttggatgacaaagcaagcgtcgccttattgctccgcttaattcatgaaattcaaacagaagacattgagctgccgtatacaacccattttcttatttccaataatgaagaaatcggttacggcgggaattcgaatattcctcctgaaacagttgaatatttggcggttgatatgggggctatcggtgacgggcaggcgactgatgaatattcagtatcaatctgtgtgaaggatgcgagcgggccgtatcattatcagctcagaaagcatttagttcaattagccgagaagcatcatatcgactataagcttgatatatatccgtactacgggtctgatgcgtcagcagcgatcaaatccgggcatgatattgtgcatggcctcatagggccgggaattgacgcttcccatgcatttgaacgcacccataaatcatctcttcgccataccgctaagcttctgtattactatgtacagtcaccaatggtataagggggaggaccaatgaagatttataagctgaaaagcacattcggctgggaaggtgatgacgggttgggagaacagctgattcagcagatccttgccggagaaaaaaccgccacgtgcgcgccgaaatcattgtattcaaaagatgaattgagggacgtttatcaaacagcgggtcagcttgttaccgtttatgataaacatgacaatccaagatgcaatataaaagtaacagatgtctttgaaaccacctttggtgcgcctgatatgaggttagtcaaaggagagggcaatggagaccgaattgaggagtttcaagaggatcatcggatggcatgggcggaactgatccaaagcggtgaactggagctgaatgaggatactgttttgattacagagctgtttgtgcttgttaaagattaaaaaaagcctgcggggcaagaaccccgcaggcttttcattaaccagaaatggttgcgttttgttctgttttcgattgggacataacagtttctgctttcgcaggattaaacatgccttcccatttagacatcacaacggcagcaagcgcgttaccagtcaggttgacaactgtacgtgccatatccatgatgcggtctacgccggcaataaaggcaagtccttcagccggaacgccgatggtgccaagcgttgcaagcaagacaacaaaagaagtaccaggcacggcagccatccctttggatgtcaccattaagacgagcacaagcgtaatttggtgccaaatcgtcaaatcaatgccatatacctgtgctaaaaagagtgcggcaatagattgatagagaacggaaccgtctaagttaaacgtgtaaccgatcggaatgacaaatgaaacaatgccttttggacatccgattttctccattttttccatgatgcgcggaagaaccgtttcagagctggacgtactgaacgccagtaagatttcgtccttcatgtaagcaaggaacttgaagatgctgatgccggcaatttttgcgacaatcccgaaaataacaattaagaagaaagcaagcgcgacataaaccaatccgacgagctttccgagagagataagagaaccgagtccgaatttagacacagtcactccgataagagcgaaaacgccgaatggcgccactttcatcacaaggtttacaacgtggaacatggcatgggatacaccttcaaaaaaggctaatacaggcttgcctctttcaccgatcgcggaaatacccaatgcaaatagtactgtaaagcagatgatggctagaagatccccttcgaccaatgactggaagaagtttgtcggcacaatatggaggaacgtttccgccactgatttattactttgttctttttcagtttcaacatattgactgatgtccgatttttgagcttcgtgtatattaactcctgtacccggatggaagatgtttgcaagggctagtccgagaataatggcaaaagtcgtgatgatctcgaagtacagaatcgttctgaagcctaatttaccgacttgctttccatttcctgcaccggctacaccgatgattaagctggagacaacaataggaatcactatcattttgattaagcgtaaaaagagatccccgattggctgcaggtaagtaggcaatgctgggttgccataccaaatgacgccaacaatgacacctagaataagtccaacgaatatttgtgtggctaatccaaacttaattcttttcatagattacctcccaaaaaacaaagtatcaacatatatcatgaatagacatatatttaatctcactattagatcaaattataatagataagaaatcaattcgtctatagtaaattatatttcgaaaataaagaatattcaatgacattatgataatcaccagaattatctaaaaacaggtgagctttgacctaacctgactattatttcaaaattaagagatatgtgaaaaaataagaaaatcccacgcgtaaggcgcgggattttcgctcattacaaatcgtttacttttatacagtcattgcagatattaccatagcactcatgctgctcttctatcttttttccgcattccgcacactttttcgaaggcaggtttctaaaaaattctgtgattttccccagcataaccaatccctctttcccctttgtagtgatttcattgtaatataacagattgcaaaaatcaataactgttttgatacaatgtttaaaacatgcttttttcaagaaaaatgggtatattgaaggaggatcaatttttttgaaaagataggaggacattatgaaagttacagttatcggatgctatggcggttttccggccgcaaatgaagcgacgtcaggctatttgtttcagtcaggtgattactctctgcttgttgattgcggcagtgccgttttgtctaagctgttcggatatgtgccggcggaaaagctggatgcggtcgttctgtctcattatcaccatgaccatatcgctgatatcgggccgctgcaatttgccaagcaagtcggttcgtttctcggcaaaggagagcatacgcttccgatttacggacatgatgctgatatagaacagtttcaaaagcttacatataaaacacatacaaaagggatcgcctatcagccggatcagccgctgactgccggtccgtttacgatcacctttttaaaaacgattcatccggtgacgtgctatgccatgcggattactgacggcagccacactgtcgtttatactgctgattccagctatcaggattcatttataccgttttcgaaagatgctgatttattgatctcggaatgcaatttttatgccgatcaagacggaacaagtgcaggccatatgaacagcctggaagccgggcgcattgcaaaagaagcgggagcgggagaactgctgctgacacatttgccgcattttggcgtgcatgacaatcttcgcaaagaagcgaaaaccgtttttaacggtgaagtgaatattgcgaaatcaggttttgtgtgggaaggataaaggaggagcaccatgttatttatagacaatcaaaatatcaatgatccgcggatcaatcttgctatcgaggagtactgtgtcaagcatttagaccctgaacagcaatatttgctcttttatgtgaatcaaccgtctattatcattgggaaaaaccaaaatacaatagaagaaatcaatacaaaatatgttgaggaaaacgggattatcgtcgtccgccgtttatcaggcgggggcgctgtgtaccatgatctggggaacttgaacttcagctttattaccaaggatgacggggacagctttcataactttaaaaaattcactgagccggtgattcaggcgttacatcagcttggagttgaagccgaattaagcggccggaacgacattgtagtggatggccggaaaatatccggaaacgctcagtttgcaacgaaaggccgtattttcagccacggcaccctcatgtttgattcagccattgatcatgttgtatcagcattaaaggtgaaaaaggataaaattgaatcaaaaggcatcaaatcgatcagaagccgagtagcaaacatcagtgagtttctcgatgataaaatgaccaccgaagaattccgcagccatttgcttcgccatatttttaacacaaacgacattggaaacgtgccggagtataagctgacggaaaaagattgggagaccattcatcaaatttcgaaagagcgctatcagaattgggattggaactacggccgctcgccgaaatttaaccttaatcattcgaaacgttatccggttggatcgatcgatttgcgcctagaggtcaagaaaggcaaaatcgaggactgcaaaatcttcggagatttcttcggtgtcggtgatgtatctgaaattgaaaacctgctggtcggaaaacaatacgaacgcagcgtcatcgctgatgtgctcgaaggtgtgaatctcaagcattactttgggaacattacgaaagaggatttccttgatctgatttattaaggcaaaacacatcgtttgaaagagcggttgtgtttttgaaataatggaggcaggagggattcacatgaaagtgtttttaatcggagcgaacggacaaatcgggcaaagacttgtctctttattccaagataatcctgatcattccatcagagcgatggtcagaaaagaagaacagaaagcgtctcttgaagctgccggtgcagaagctgtgcttgcgaatctggagggcagcccggaagaaatcgccgctgcggcaaaaggctgtgacgcgatcattttcacagccggttccggcggcagcacaggctatgataaaacgctgctggtggatcttgatggagcggcaaaagccattgaagctgcggacattgccggaatcaaacggtttattatggtcagcgccctgcaagcccatcaccgtgaaaattggaatgaggcactcaagccttattatgtggccaagcattatgctgataaaattctggaagcgagcggtttaacctatacgattatccgtccgggaggccttcgcaatgagcctggaacgggaactgtttcagcagcgaaggatctggagcggggatttatttcccgtgatgacgtggcaaaagcggtcattgcctctttagatgagaagaatacggaaaatcgggcctttgatctgacagaaggagatacgccgattgccgaagcattgaagaaactatgacagtactgacactcagggctttttgctcttgagtgtttttttctgtttctctataatggaggagaaagcttggcttcaataatgaatgactattcattcactttaaggggtgggagaatgaatcttgtttcaaaattggaagaaacagcatctgagaagcccgacagcatcgcatgcaggtttaaagatcacatgatgacgtatcaagagctgaatgaatatattcagcgatttgcggacggccttcaggaagccggtatggagaaaggggaccatttagctttgctgcttggcaattcgcctgattttatcatcgcgttttttggcgctttaaaagctgggatcgtagttgttcccatcaatccgttgtacacgccgacagaaattggttatatgctgacaaatggcgatgtaaaggcaatcgtgggcgttagccagcttttgccgctttatgagagcatgcatgaatcgctgccaaaggttgagctcgtcattttatgccagacggggaggccgagccggaagctgcggacccagaggtcaggatgaaaatgacaacgtttgcaaaaatattgcggccgacatctgccgctaaacaaaaccaagaacctgtacctgatgataccgcggttattttatatacgtcaggaacgactggaaaaccgaaaggcgcgatgctgacacatcagaatttgtacagcaatgccaacgatgtcgcaggctatttgggaatggatgagagggacaatgtggtctgcgctcttcccatgtttcacgtgttttgtttaaccgtctgtatgaatgcaccgctgatgagcggcgcaactgtattgattgagcctcaattcagtccggcatctgtttttaagcttgttaagcagcagcaggcgaccatttttgccggtgtgcctacaatgtataactacttgtttcagcatgaaaacggaaagaaagatgatttttcttcgatccggctgtgcatttcgggaggcgcgtccatgccagtcgcgttgctgacggcgtttgaagaaaaattcggtgttaccattttggaaggctacgggctctcggaagcatcacccgtcacgtgctttaacccgtttgacaggggcagaaagccgggctccatcgggacaagtatcttacatgtcgaaaacaaggtcgtagatccactcggacgcgagctgcccgctcaccaggtcggcgaattgatcgtgaaaggccccaatgtgatgaagggctattataaaatgccgatggaaacagagcatgcattaaaagacgggtggctttatacgggggacttggcaagacgggatgaggacggctatttttacattgttgaccggaaaaaagacatgatcattgtaggaggatacaatgtgtatccgcgggaggtggaggaggtgctgtacagccatccggacgtcaaggaggcggttgtcatcggcgtgccggacccccaaagcggggaagcggtaaagggatatgtagtgccgaaacgctctggggtaacagaggaggacatcatgcagcactgcgaaaagcatctggcaaaatacaagcggcctgccgccattacgtttcttgacgatattccgaaaaatgcgacggggaaaatgctcagacgggcactgagagatattttgccccaataaaacgaaaaagcgaagcggttagcttcgctttttcattttcaatcctttgcttcttttttaataatatttagcagcgcctttgtatcatttttgctcaatttgtagtatgtgccatccttcgaaaaaacggcttgctggctgccgtcaatccatagtctgaatgagtcataccggtctttatgaaacttgattgtcccttcgtaatcaggggctgatgttttttctgtcttcacctgttttccctgattcataatatccagcatatctttgacgtgctgtcttttttcaatctcgatatcttcctggccgcttgaagacagtgtgatcaaatccgcgtctaccgattgatacacatcgcctgatcggctgtaaagataaaaaaatgctataaacacaagaccgattaccacgatggctgccactatttttttcatttgcatcactccaaacattgttagttttcccagcgatcgggttttccatgcttaaaaggatggaaaagtgcggaacacagcttggttctaagaatttgaatttatgattacaatagaagtaacgggttgatgtgaggagtgaggcgttatgcgcaagtggattgcggcagcaggacttgcttacgtgctgtacgggctgtttttttattggtattttttcctgtcgggtgattctgcaataccggaagccgtgaaagggacgcaggctgatccggcttctttcatgaagccgtctgagttggcagtggccgagcagtattcgaatgtcaagaattttttattttttatcggggtaccacttgattggtttctgttttttgttctgctggtcagcggtgtttcaaagaaaatcaagaaatggatggaagcggccgtgccttttcgctttttgcagaccgttggttttgtgtttgtgctttcgctgattacaacattggtgacgctgcctttagattggataggctatcaagtatcgcttgactataacatttccacacagactacggccagctgggctaaggatcaggttatcagcttttggatcagctttccaatctttacgctttgcgttctcgtattttattggctgatcaaaaggcatgaaaaaaaatggtggttatacgcctggctgttaacagtgccgttttcgctgtttctgttttttattcagccggtcattatcgatcctttatacaatgatttttatccgctgaaaaacaaagagcttgaaagcaaaattttagagctggcagatgaagccaatattccggctgaccatgtatatgaagtgaacatgtcagaaaaaacaaatgcgctgaatgcctatgttacaggaatcggggccaacaaacggattgtattgtgggatacgacgctgaacaaacttgacgattcagaaattctgtttattatgggccacgaaatgggccattatgtcatgaagcacgtttacatcggtctggctggctatttgctcgtgtcgctcgccggattttatgtcattgataagctttacaagcggacggttcgcctaacccgcagcatgtttcatttagaagggcggcatgatcttgcggcacttccgctgttattgcttttgttttctgttttgagctttgcggtgacgcctttttctaatgctgtctcgcgttatcaggagaataaggctgaccagtatgggatcgagttgacagagaacagagaagccgctgttaaaacgtttcaggatttggccgtgacggggctgagccaggttgatcctccggtgcttgtgaagattttcagaggcagccatccgtcgatcatggaacggattcaacatgcggaaaaagaagagaatgcgccggaacatcaggatgctgacaaataaaaagaagcaggtatggaggaacctgcttctttttactattattgtgcagctgcttgtacgttgattaacccttttccatagtagaaagagtttccaagatatgttgcagtgctttctaaacgatcacggacttgcgcgtttgtccaagtcgggtgcttagaaagaattaacgctgctgctccggcaacgtgaggagtcgccatggacgtgccgttgtaagcaccgtaagtgcctccaggaagtgtgctttggatggatacgccaggagccatcacatcaagctcggaacctgcgcttgagaatgaagctctttggttgctgctgtttaccgcacctaccgcaatagtagaaggatattttgcagggtagccgactgtgcttgagcttccggacgaaccttcgtttccggcagcagcagcaacgacgataccgctggaaacggctttatcaacgactgttttcagcgctgtagaaccagtaggtccgccaaggctcatgttgataacatccatattgttggaaatggcccactcaatgccgttaataatccagctatattggccgcttcctgttgaatcaagcacttttactgcatataatgatgcgcttggcgctacgcccagaacaccgattgagttattaagagcggcaatcgtaccggctacatgcgtaccgtgagaactgccgtcctggtatgggtttgtttcagaaggtacgaagcttgctccgcctctgacgtttaagtcaggatgagaagagtcaattccgctgtcaataacagctacttttacgttagagcctgtatagccttgagagtgaagagccggcgctttaatttgagaaatgccataaggaacagattgcgcatattcatgtgcaatatgatcttcttccacatatgcaacgctcggatcttttttcaattcttttacagctttttcatccaatgttgctgcggccgcgttaacatacttaaattgcttttgaacctttccgcctttttcagaaataacatcctttttcttggcggaactcatggcactcattgtctgcttaaatccgacaatatatttcttttctgtactgctttttccggcagcctgcgcagacatgttgctgaacgccatcgtaaagattaacgttaacgcaaacaacaagctgatccacaattttttgcttctcactctttaccctctccttttaaaaaattcagagtagacttacttaaaagactattctgtgaatttattgtaatagatggaataatattttagtagacccatttttttgagatgattttatctctatttaggtatatcatctctcgctatttccgtagagactcgaaataactattttcatacagaaaagaacgaaaatagacatgagtaaatgttcattatgctgaaatgtcatgcttttttaggttaaatgctcctgagtccctgcaaattcctgtcgaaaaaattcgttcaaatgacctgcatatgcttccgtgagaacaatggatattatcgtgatattttttcaaagcatgatgataaaagtattctgaaaaataaactttacagaaaagggatagaataaaaaaattattgagagggaggaagaaatgagatgaacattcgccaagcaaagacatcagatgcagcagccctcgcgccgctgtttaaccaatatcgggaattttatagacaggcatccgatttgcaaggggcggaggcttttttgaaagctcgtttgaaaaatcacgagtctgttattttgatagcagaagaaaatggagaattcataggctttacccagctctatccaacgttttcttctgtgtcaatgaaaaggatctacatattaaatgacttatttgtcgttcctcatgcgcgtacaaagggagccggcggccggctgctttctgccgcaaaggattatgcagaggaaaacggggcaaaatgtttaacgcttcagactgagcaccacaaccggaaggcaagaagcttgtatgagcaaaacggctatgaagaggataccggatttgtccattattctctcaatgtgccggcgaagtgaaagctgtggcttgatgatttggttttttgaacgttcttcggttacgatataaatgaaaaggagtgtgccgaatgtcaacgttatttcaagcattgcaggctgaaaaaaatgccgatgatgtttcagtccatgtgaaaaccatatcaacagaggatttgccgaaggatggtgtcctgattaaagttgcttattccggcatcaattacaaagatggtctggccggaaaagcaggaggcaatattgtcagagagtatccgcttattttaggcatcgatgctgcgggtacggtcgtctcttccaatgatccgcgttttgcggagggggatgaggtgatcgcgacaagctatgagctcggtgtctcacgtgatggcggattaagtgaatacgcttcggtgcctggtgactggctggtgcctttgccacagaatctttcgttaaaagaagcgatggtgtacggaacggcgggatttactgcggcgttatcagtgcatcggcttgaacagaacggtctgtctccggaaaaaggcagcgtgctagttacaggagcaaccggcggagtcggcggaattgcggtatcgatgctgaacaagcggggctatgatgttgtggcaagcaccggaaaccgggaggcggctgattatttgaaacagctcggtgcaagcgaagtaattagcagggaagatgtctatgacggaacgcttaaggcgctgtccaagcagcaatggcagggagcggttgatccagtcggcggaaaacagcttgcctcgcttttaagcaaaattcaatacggcggatctgtcgcagtgagcggcttaaccggcggaggagaagttccggcaacggtgtatccttttattcttcgcggagtaagcctgctcggaatcgattcagtatactgtccgatggacgtcagagccgctgtttgggagcgcatgtcttctgatctcaagcctgatcagctgctgaccatcgtggacagggaagtatcattggaagaaacgccgggtgcgttaaaagatattttgcaaaatcgcattcaaggaagagtgattgtgaagctttaacaggatcagcttgcagagaatgttatttttctgcaagcttttttgtggacaggatgatcagctgctgaactgctgtgtcgcgaaacaagattttcatgtaagcggaactttctcttctcatttaaaaaataattggtgataatgattctcattccgtgttatactactcttggacatcttaaccatagaaactaccaacaggagagactggaacatatgaaaaaaacactgattattcttacagttttacttctttctgtcttaacggctgcttgctcgtcttcaagcggcaatcaaaacagtaaagaacataaagtggcggtaacacatgatttagggaagacaaatgtgcccgagcatccgaagcgggttgttgttcttgagcttggttttattgatacactgcttgatctcggcattacgcctgtcggggttgccgatgacaacaaagcgaagcagctgatcaacaaggatgtgctgaagaaaattgacggctacacatctgtcggcactcgctcacagccaagcatggaaaagattgcttcattaaaacccgatttaattattgctgacacgacccggcataagaaggtgtacgatcagctgaaaaaaatagcgccgacgattgcgcttaataatttaaatgctgattatcaggatacaattgacgcttcgcttacgattgcaaaagcagtcggcaaggagaaggaaatggagaaaaagctgacggcgcatgaagaaaagcttagcgagacaaagcagaaaatcagcgcgaacagccagtccgtgcttttgatcggaaatacaaatgatacgataatggccagggatgaaaacttctttacatcgagacttttaacacaggtcggctatcgatatgcaatcagtacgtcaggcaatagcgattcaagcaatggcggcgactctgtgaatatgaaaatgacactggagcagctgctgaaaacagatccggatgtgatcatcctgatgacaggaaaaacagatgacctcgacgccgacggtaaacgcccgatcgaaaagaatgtcctttggaaaaaactgaaggcagtgaaaaacgggcatgtataccacgtggaccgtgcggtgtggtctttgcgccgcagtgtagacggggcgaatgccattttggacgagcttcaaaaagagatgccggctgctaagaaataaaagaaaagacaggcaaacgcctgtctttttcttatttgataaagccggataagtggctgttgatattatagtcttttatccgccatttttcttctgcaaattcaatgttgctgaggcaagcgttgacgaggcgcgtgctttgaagctccgggtcaccgcccgatatttccgtcagcagtgcgtgaattgccgcaccgtgcgccacgatcagtaccttctggtttgggtacgcctggttcacttttgccaaaccgcccatcagcctgtcagtgagttcttctaacgtttccatattcggatagatgttatccggatagcgctttgtccgttcctccagcggcatgccctccgcgtcgccgtaatcgcgttccttaaaatcatccatctcgacaatcggaagatgcaaatattcattaataatttccgcggttcttttcgctcttttcagcgggctcgtcacaataatatcccaagaaaagtcctttacatattctccggtttctcttgcttggcgttcacctgttgcgtttagcggaatatcggtttttccttggcatttttgctgcaggttccaatcggtttctccatgtcttactaagcaaacggctgtcataaaatccccttcctgactttattcatatcgctattatactaaatcgaaagcgtgcatcctataaaaaagcctatgcaagaacttcaaataataaagccagcccaattccgccgccgcttccgatggctgcaacagcatattgacagtctgtccgtcttttcgcttcataaaacaatctggttaccagagctgcacctgatgcaccgtatggatggccaagagctaatgcgccgccgcgcacattgatttttgaaaagggaatgccgagttcttgcgagcagacacaaattttgacggcaaaggcttcgttgatttcaaataaaccgatatcatcaggtgttacatcgtgtgtatgtaagagattacggatcgcatcaaccggtgccgcgggcggatagttggggtgaatcccgctgactgcgctgccgataaaccggagcacaggcttaagtcccagggctgccgctttttcttcttccattactaaaagagccgctgctccgtctgctatgccgctgctgttggctgctgtgactgttccggagctggtgtcgaaaaccggctttgcgcggggaataatcgcttttatcggacgtgttttcaaaaatgcttcgtctgtctccaattcccgagaggaacaatttcttcacggtaaaatcctccatcatgcgcgttcctgctgcgttgatggctgagaagcgcgtactcatcctgcatgtttctgctgatggaatagcgtgctgccgtatattctgctgcgatgcccatgtcgggatcgccgatggcatctggagaaaagcgggcccgttctgaaaaaggggattggctgctgctttctgagccgcccgcgatatacaccgtgccggctcccgcttgaataaggctgcaggcatagcgcacagcttcaaggccggagccgcactgtctgtcaattgtcattccgggaaccgataaaggcagtccggcttgaagggctgacagtctggcgaggttgccgcctctgccggtagcatttccgagaataacctcgtcaatttgatcctctagctttcggctgagacagcggatgatgggagccgccaaatcctccggcaggaagggcttcagcagtccgttttgatttccaaagatcgttcgctttgcatcaacaataaccgcattcaattatactgtacaccctcttccagccattttttcacgctggaacgggcaatttttccgctgctcgtttccggcaagctgtctgcaaacacccattttttcgggattttgtaggaggctaatttctgtttacaccagactttcagtgttctggcattagcgtttccaagaatgacagctacagcgatttctccccaatactcgtcgggaattccaacgacagccacgttttcaacctctgggcaggcgagaagcacacgttcaatttcttctgggaaaatatttaatcctccgtacacgatcatcccgttttctcttcctgatatgtatagaaagccatcctcatcaacatagcccatatcatccactgttatccattcatctggtgtgctgccgttaacatagccggaaaaacgcatcgggcttttgacaaatatttttccgatttcccctggctggcagcgttctcctccagcgttgcggatttcgatccggacattatgaaaagggcggcccgctgaatgaggcttccgtttgctgtcttccggtgaagaaaacgtaacaaaacttagctctgatgtgccgtaaaaatcgtacagcttgagatgaggccatgcagcggcaagcttctccttggattctgccggccagtctgcgccggatgaaatgattttgacgggactgtcgggaaaaccctcaatccttgtgagggcgtctgtcatcgtcggtacggtatagagaacgctgatggattcacggcacagccattccttcgctttggcaggagaaaactttttcagcaaacaaacggttcctccgagaaacaaagtgctgacagccccatataggaagtgagaggacattaacgttccgggaatcagaaccttatcatctgatgaaatcgaaaaatctgttcctgtacaggtaaagctctctatccatgagcggtgagatcgcgtaaaggccttcggttttcctgtcgagcccgacgtaaatcccatataaaaagggtgctccggatcaatggtaggcaagggatcagcggctgcttcagaaatatctgccatacagttatccagcaatacaacaggtgtctggctatctgtcagtttgtttttaaaaaaggctaaagtaaccacaagatctgcattgcttatggacagccgctccttacattcagccgggctccagcgtgtgtcgatgggaatggctgtgcatccagccgctgcggctccggcaaacagctgtaaaaacgccagactatttgggagcaggatcgccacacgattcggcaagctcggctgtgacctcagccaatttgcggtttgaaagacaagacgagcccaatcctggtacgtgatttgctccgattcagtctggatcgccacacgcccgggcgatgtttcggcggtagatgaataggtatgagtaattgtcatgtagtgtcatcctccttttgtaaacatcgtatcagaaagagacaaggcttgagtgatttttatcgccagaaatgcagatgcagccgcttttatcaaatcaccaggcacatatgcaaggctcatgaaggcggcctgtgacaaatcaatatgcatgataaaagcttgtaccggtataccaagcagataaataaagatgatgccgaatacgatatgagtgaaaaagagacgcaatactgtcaccttccgcagcctgttagcggctaaactgatcagccatgaagcgaggggataagcaatcaaaaagcctgcgctcggtccgaaaaacacaccaaaaccgcctcgtccgccgggcaacagcggcgctccgaaggcgacgagcagcaaaaagacaagctggcttaagaaagcagactttggcctgaggatactgcctgccaacatgacaccaagcgtttgcaatgtaatcggaacgggtgtaaaggataagaagagagggggcataaagccgagcactgccatcagtgcggtgaaaatcgcaatatgcatcatgtcgattaatttcagcatgtgaaatcctccaaacagtaatcaaatatggttatacaataaatgcaggtaattatcatgtcaaccaatttttaattttggtttacataatgaacacagaaaaaccggccgtatggcagaccggtttttgatggttattcttctgtcaggatgacaagcgaatcaacggaagcggccacatgggaaacggcgcggctgacttcctgaagccctccaagaaaggcttgcagatcgacgtcgatttttcctgattgctctttgctgattttcatgctgtggacgatttcatcgaataagcggttaatttgcgtcattttttctttactttcgctgactagctcatttacgtctttgatatgcttcgatacaatgttgatttgtgtattcgtattgttcacaagctcagaaacagtagagacggtttttttcgtgtcctcagaaagcttccgcacttcatttgccacgacagcaaagcctttgccgtgttctccggcgcgggcggattcaatagatgcattgagcgagagaaggtttgtttgttcagctatgcctgtgacgatgccgaagattttttcaatttgctgcgcgatttcatccagcttgaccatttctttttcgatttggacaaggcttgtgtcaattttgttcatctgtttttgctggacttctagctctttttttccgccgatcgacttttcttcaacagtgctggatgttacagtaccggctttggatgcttgagaaatgccttcagatttgtccacaagctcttgaactgacctgcttgtttctgaaaacagattggcaatcgatccagaggtttcttgaattttctgatgaagaaggtttttcttttcttcttgttcatcacgggtctggttgtactcgctttgaaacgcttcaaggacaagctgctgttctaagttcaagatttttgttgttgctttaatggcttttagcagttcttgctgatttgtaatagacgcttcataaatgtcaatcattgacaaaagaagctcttgaaacgcacccatataccattttggcaaaaggccgatttttaaatggatggaggcgattcggttacgcttttcaatgaattcatcatcgataacgcctgcaaacatttcctgaatatgccgttttaacgtttgttttaagcggtcaactgagctgtgatcattaatgatatccatcaatgagctttcatggtcaaggtttttataaaacgcatcgacgatgtatacgatattttcttgaatgagtggctgaagctgctctaacacgtaaagctcagcatctcccaacctgaccattttgagctgttttttgacatctgcatgtttgtttgtgagctgaatgcggtttttttgctgtccgtttgaatctgaaaagtaagctgtttcttgttttctgtcttttttaaataacaatacaatgatcccccttgggaaaaatataatttttactttttggctttttaagcctttttcttttttatcggccaagggaaacatgaatgaagctgcagatgaaaaatatttgaaaaaccgttcattaaaatgaacggtttaatcgagatctatttgttttaatggtttaatggccggaccctctacaacttcgccagatggcttaaagcgtgatccgtggcacggacaatcccacgtatgctcactgtcgttccactcgacctcgcagcctaaatgggtacaagtcgtatcaacgagatggaggcagcctgtctcatcccgaaatgctcccgctcgcctgccgtttatggtgacggctttcccttctcctggcgaaatgtcttcaaattggacatcaggcttttcaagctttcctttaatcaaatgcttggcgacatcggcattgtaggaaatcactttctgcaacccgggattcagatggaaacgggacggagtgaaaatgctttcgtatggattgtcttttttctccacaaggtctgacaatagagtggctgcgactgctgaggacgtcatgccccattttttgaacccggtcgctactagaatattgtcctcattttccgacatcggcccgataaacgggattttgtcgatcgtcactagatcttgggtggaccaataatatggaatgctttcgatgccgatggtgctttcggccagttgtcttagtgtttcataatgtgtagacatgtcttttccctggcctgttttatggcttactccgctgaagagaatcagcttttcaccgtttacaaccgtatagcggagcgccactgacggctgatcgatactcaaatacatgccctcgggatactcgatcttcggcttgatggcaaggacataagatctgtcggagtacattctcgcagcatataatccgcctccgtcataaaaagggaagtgggaacagcatatgataaagcggctcttaatggcgtgccggctttttgttaccacttcgggcctttcgccttttttgatatcaagcgcaacggtctcttcataaattcggccgcctttttgaacaatttgctccagaagcgcttttaagtattgaagcgggtgaaattgagcttgattcttcatgacaagcgccagcttagaacctaagggaattggaaggtccttgataaggtctctttcaattccgagctttgtgtatgcctcatgctcggtgcggattttttgaacagcgttttcatttgccgtataaagatatgcgtcttgctcgatccattcgcaatcaatttgatgttcatccacaatgccttttatgtaatcaattgcgttttggtttgcttcataataaagcctcgcatggtttaatccgaaatggcggataaattcgtcgtatatcatgtcgtgctgtgcggtaactttagcagttgtatgcgcagtggttccgttaagaacctgatttgcttcaatcaaaacgacacggaagcctctcttcgtaagttcatatgccgttgtgattcccgtaatcccgcctccgataatggtgatgtcacattcagtgtcctcttgaagcgcaggaaaagaaggcaggtcagttgatgttttccagtatgtttcaggtgcttcctttgcaaaatgttgattagccaagccgttatacctccaatcagatttattcttaatttttccatattctatcttttcatacataggaagcaggcattgttcataacataataaggttgaaaaggagtgatttcattggcgaatcaaaaaaagaaaacattaccgcctcagcaccagaaccagcagcctggttttgaatatctgatggacccgcgtccggtttttgataagccgaagaaagcgaaaaaattagagggcaaaaccgctattattactggaggagacagcggaattggacgcgctgtatcagtgttattcgcaaaagaaggggctaatgtggtcattgtgtatttgaatgaacatcaggacgccgaggaaacaaagcagtatgtagaaaaggaaggggtaaaatgcctgctgattgcaggagatgtcggggatgaagcgttttgcaatgatgtggtcgggcaggcaagccaagtgtttccatctattgatatattggttaacaatgcagctgagcagcatgtccagcccagcattgaaaaaatcaccagccaccagctgatcagaaccttccaaacaaacattttttccatgttttacttaacaaaggcagtgctgcctcatttaaaaaaagggagctctattattaataccgcttctattaccgcctataaaggcaataaaacgctgatcgattattcagcgacaaaaggcgcgatcgttacgtttacaaggtccctttcccaatcgcttgttcagcagggcatacgggtcaatgcagtggcaccgggtcccatttggacaccgcttatcccggccagctttgccgcaaaagacgtggaagtgtttggttcagacgtgccgatggaacgcccgggacagccggtcgaagtggcgccaagctatctataccttgccagcgacgattccacatacgtcacaggacagacgattcacgtcaatggcggaacaattgtgaacggataataaaaagccaatccttgaaggattggcttattcgctctgcttgagcgctgcatattctttagagagcgtaagaaacgcatctttatctttttcgtccaaggctttgttaatttggtccgtcagcatggcaagccgacggttatacaaggattcatcgagcaccatttgaatgtaaatatccgtcattgtgacatcgaattcttttgttttttgcgtgttgcgggacttcatgagctcagtgtacgattttttctctttcataaagaatccccccaatgccttttttatagtatatggataacggtcgaaaaaatcaataaatttttataatttttagacaactaatacttggcaatctatcgacatatcctgcaaaatgccgtaaaccggaaagtcttatgaaagtaaaatcggtttattactagtaatttagtaccattaaatatcattaaaagatgattttatcttaaatgttaaaaaaacctgtcgttttataaaaacagatgatagattattagtataaattttgcagaaaaaggatggaggccataatatgagtcagaaaacagacgcacctttagaatcgtatgaagtgaacggcgcaacaattgcagtgctgccagaagaaatagacggcaaaatctgttccaaaattattgaaaaagattgcgtgttttatgtcaacatgaagccgctgcaaattgtcgacagaagctgccgattttttggatcaagctatgcgggaagaaaagcaggaacttatgaagtgacaaaaatttcacacaagccgccaatcatggtggacccttcgaaccaaatctttttattccctacactttcttcgacaagaccccaatgcggctggatttcccatgtgcatgtaaaagaattcaaagcgactgaattcgacgatacggaagtgacgttttccaatgggaaaacgatggagctgccgatctcttataattcgttcgagaaccaggtatatcgaacagcgtggcttagaaccaaattccaagacagaatcgaccaccgcgtgccgaaaaggcaggaatttatgctgtacccgaaggaagagcggacgaagatgatttatgattttattttgcgtgagctcggggagcggtattagaaaatagaaaggagctgacccacagggcagctcctttcataaacctatgccgtcggaattcctccggtgattccatatacctgagatgtcacatagcttgaattctctgaagccagaaatacataaacatcggccaattccactggctgtccagcgcgatttaatggagctggcggcgtggcttgtccgaatttcgggatgttttccgtcggctgtccgccggaaatttgcagcggtgtccaaattggtccgggcgcaactgaatttactctgatgcctttggaagcaagctgttttcccagtccgacggtaaagccgataatggcgtttttcgttgctgcgtaatctaacagcatcgggcttggattatagccttcaactgaggtagttgtgataattgaagctccctccggcaaatacggaagcgccgcttttacaacccagtaaagggaaaagacgttcacttcaaatgttttatagatttgttcagtaggcagatcttcgatgttttcgaccgcttgctgtttgcctgcaacgagcgctagcacatcaagtccgcctagttcgtgatgcgactgtttgactagatcttggcaaaaggattcgtcgctcaagtctccggggatcagcactgcttttcggccttctgcttcaatcagctcttttacctcttcagcatctggctgttcctcgggcaagtagttaatggccacatcggcaccttctctggcataagcaatcgcggcagcgcggccgataccggaatcgccgcccgtgacaagcgcttttcgacccgttagtttacctgatcctttgtagcttttttctccgcaatcagggacaggcttcatgttcttttgcaggcctggcggttcttgatattgttcgggaaattcatcatgaaaaaatgcttttataggattcgtaagatttgaatcagacatcagcaacgctccttttctgtttggtgtacattcgtatgtgtacccctgagcataaggagaaaaacatgttttggcagtttgaacactgaaggaccaaagaaaacaagaaaaaacaaacccttcttccatatttatcttgtcaaataagactatatgaattatgataaattcgagctataaatcaactaaatattgggtattggggagtgaatcgtcatgaaaaaagcggcggcggttttgctgtcactcggtctcgttttcggtttttcatacggagctgaccatgtggcggaagccaaaacaaaggtgaaggtctataagaactgcaaggagctaaacaaagtatacaaaggcggagtggcccgcacatcgaaggtgaaaaacaaaggcggaaaaacgaagtacaagccttacgtctctaaggcgctttatgatgccaataaaaataaagaccgcgataaagatcttatcgcctgtgaacgttaaacaagaaaaagcaatctgatgaccagattgctttttctattgcttaggccgcttgatcggccgcagcgcttttcgccttccttgtcataaggctgactgccatcatgaccgtgatattcaaaagcagggcaacgatgcctacattcaagtcttttgcggcttgcggcagagccggaaataaagtgccgatcgtcgtttccgtcattgtaatataagtaactgctccgacacctgcaataatgccggcgaaggctccttgctttgtcaccatattatgcttgaacaggctgaacaaaagggcggggaatagctgtgtgacaaggctgtagcccatcaaaagcaacgtaacgatggtattcccgcctttgaaggtaaaatacaccgaaatcaacgcaatcaccggcactaaaaacttagcaagagccgatacctgttgttctgtcgtgcggggcgcaattaccttgtacacattttttgcaaacagcgtggaggcggacattaagatcatagaccctggcacaagtgctgtcagcagtccggcagcaccgataattccgacaaaccaagggtcaaatgcttgcagagacagtttcaaaagcgacaaatccccgtctgcgcctttcagatctggaacttgcaggatagccgcgaagccgacgaaaaggacgaagagcaggaccagctggtacaaaggcatgatgatggcgtttttacgaaacacttttgggttttcggctgaatacgaagcggaaaacgtgtgaggccacatgtaaaaaccaagcgctgtcaagagtacggttgaactgaaccaggccacactttgtcccgattcgggagcgtaagaaagccaggctttgccgtttcaatctgctgaaacatgtcttgaaatccgccgtagtaatgaattggcaaatacacacctaaaaacagaacgacaaccagaatcatgatgtccttcacaaccgatatccaggcagacccgtgaatgcctgaaaccataacataaaccgtgatggaaacagcgccgatccagatggcagcggtcggggtgattttgccgtacgaggtttccgatacaatcagcccgaggcctttcagctgcagtacaagatagggaatgagtgcggcgatgccgaccagtgaaacgagaatgccaagcagcggactgttgtatttttttgtgaaaaaatcagactgcgacatcagtttatgctgtttcgcgtacgtccaaactgctggaagaagccagtaagaaaggatgtaggccagacatccgtaggcgatgatataaaaggctggaccgccttttccgtaggcccagccgctgccgccgagaaacgtaaaagtagtataaatttcgcctgccatcaaaaggaagacgaaaacagttccgaagccgcgccctccgaccgtccactgctccaggttcatgtcttttcctttttgggcgcgtataccgagaaaaatactcaagagcaggacaccgaagatgatgatgagagctgcattcattctgcttcctcctttttattttccttgtcgaggacatacacaatcgccatcagcgcagaggtcaaaagagcccacatcacaatataggcaagaataaacggcatgccgaacacatagggggtcaccttatttgcaaaagggatgccgagtaagattccgataaagggcaaagcggcaagaacgtgaatcagtttcatagaatcctccttctatttaggattggggtgtacaagcctaagcgtaatgaaaatgatgtcgcagatatggcagcacatgtcactttttagggtgaaaggctgtggttcgaattataaataaatttattttgtttgtatagtgtgaattgtctgaaattaatgatctgaatcgcccgaagagggaacgggcagtatgattcaaaaggctcggagtctgtctggggcaaatagatagtatgttaataattcgctgacctgctcacggattcgcggattaaaatagcgatggttttcttcataaccgtcgatgacaaatgtatagagtgtaaaggcctcatcgcgttccgtctcgcggattgcaatttttcttttcctcagttcttttctgacctccatcaaatccttttgtgctatttttaatgattcgctgataagctgtttataaggatgcttcaattttaatgtgctttcttcaattccggcgagatcacggttaaaaatcgtaatggccatgggcaaaaagagagcccgttcaattaaatcgtatatttcctcctgcagatttggcatgttgactccttctttctaagggaacgtttgttctatttgtattctatatcggctggtgaaatgtttcaagacagaaaaaatcaccaaaactttttagttttctgctgataatgtgtagaataaggatagacaaacccggtaaggagtataaatgttggagcattttttatcctatttgacacaagaacatttaactgaattatttcaaagctatagggctttcggtccgctcattgctgtgctgctgcctttaattgaagcatttctcccgtttttgccgctgatcgtgtttgtggtggcgaatacgaactcgtttggcttgtgggaaggattcatcctgtcctgggcgggatcaactgctggttccattctcgtctttttgattgtccgtcaatacggacagagaaaattgcttggatttatccgcagtcatccgtctgtcagaaagctgatgttatgggtggaaaggcacggcttcggtcccatgtttcttctgctttgttttccatttacaccgtcagccgcagtgaatgttgttgctggtttgtcaaggatcggaacgcggccgtttattttggcggcagcctcggggaagcttgtcatgatttttatgatcagcttcatcggatatgatctgcacgcgctgattacacagccgattcgaacggtcatcgccgtattggtgatcactgtcttatggtatgtcggcaaaaaggtggagcggtatctgtatgtaagagccagtcagcgtgagcatgatggagggagacagtaacatgaaaaaacggttttggtttcttgccggtgtagtgtccgttgttctcgccattcaggttaaaaatgctgtctttattgattacaaggtagaaggcgtcagtatgaacccgaccttccaggaaggaaacgaattgttggtcaataaattttcgcatcgatttaaaaccatccatcgttttgacatcgtcctttttaaaggccctgatcataaagtgctgattaaacgggtaatcggcttgcccggtgaaacgatcaaatataaagatgatcagctgtatgtgaacggaaagcaggttgctgagccatttttgaagcatttgaaatctgtttctgccggcagccatgtaacgggtgatttttctttgaaagatgtgacgggaacaagcaaggtgccgaaaggaaaatattttgtcgttggagataatcgcatatacagcttcgacagccggcattttggtccgataagagaaaaaaatattgtcggtgtgatttctgatgccgaataaaaagacgctaattgaagaggcgtctttttgtatgccgtttggaaaaatgtgttgaagaaaaatttgtaaggagctataatcaatattgttacgcgcgtaacaaaaaaacggttgttttatgattatgggttgtttttattagattttgttcgttttgtatgaaacaaaaggagtggtgaatgatgatgaaatatgaagcagtgattataggaggagggccggtcggatttatgctggcttctgagcttgcgatggccggagtaggaacatgtgtgattgaacggcttgaaaaacctgttccgcattccaaggcgttgacgctgcatccccgaacgctggagcttcttgagatgagagggattttagagcggttcgtatccaagggaagcaagataccttccggacatttttcaatgctggatacccgtctggatttttcaggcttggatacgagctgtccttacacgcttttgctcccgcagtcaaaaacagaaaagctgcttgaagatcatgcacgaagcctgggaacagaggtgtttcggggtgcagaggcgctggcggttacgcaaaacggggaagaggtccaaacaatttttaaggatcgggacggcagtgtacggacaatcacaagcaagtttgccattggtgcagatggcgccggaagtaccgtccggaaacaggcgaaaattgagtttccgggaacagacagcactgtcaccgctgcgcttggggatgtggcgctcctttctccgccgccgtcaggcgtgctgtccctttgcacaaaagagggcggtgttatgattgttccgttatctccagaccgataccgtgtcgttgtgatcagtccttatcgcacgcaaacgccgaaagatgtgcctgtgactgaggaagagctgaaagctgacctcctgcgaatttgcggaactgacttcggtttaaccgacccttcgtggatgtcgcggttcgggaacgccgcgcgccaagcgaaacggtatcgggacggcagaatctttcttgcgggtgatgccgcgcatattcattttccagcgggcgggcaaggactgaatgtcggccttcaggatgcaatgaacctcgggtggaaactggcggcggccatcaaaggctctgcgccttcgtggcttttggacagctaccatgacgagcggcatccggcagcggaagggctcctcagaaacacggaggcgcagacaaagctgatcgatttcactcaagcaggtctccatttgcgaagcatgatgtcggagctgctggccttccctgatgtgaatcgatatgtagcagggcaaatttctgcactcgatgtcagatatgaagctgatcgtaccatgccgccgaatcgtttgaacggggcaaggctccctgacatggagctgattctttccgacggcagttcggaatggctgtacagttttctccaaaacgggacattcgttttgctgtcattgaggcaggaagctgatgatcatatcgaagtgaatggcttacgttcggtaaccgtctcgcttgcagaaccgaatgaaaagttgcgggatgtgcataccatattgattcgtcccgatggacatgtagcctgggcggtggatgcatcagcgcccgattgtgccgaggtgattcaaaaagggatcagacgctggttttccgtcaccagccgagtataattcaattcgattgtttcatctgtaacaaaacggtatgatagaagaaacaatcgaatgaaaaaggatggaagactcgatgaacacagatcatacgaaacgcaatctttttgaattgtatgcggagctcatacatcagcaggagaaatgggaggggcttattaaagtctttttatctgacgaattgaggaagctggatgtagagcacgggagtaaatctcaattgacgatgacagaaattcatgttctatcctgtgtcggggacaatgaaccaattaatgtcacgtcgatagcagaaaaaatgaatacgacaaaagcgactgtatcacgcatcagcacaaaattgctcggcgcaggcttccttcacagaacacagctcagcgataataaaaaggaggtctacttccgattgacgcctgctggaaaaaagctgcacagtttgcacaaatattatcatcagaaggctgaacagcgttttctgtcattttttgaccgctataccgaggaagagattctttttgcggaacggctgtttcgggatctggtgacaaaatggtatccgtcgtcagaagaaattgaaggggggcttcctagcatttttaaataaaaaaacacgcactgcggtgcgtgtttttcacgtttcttctttctttttcaagattgtaacgtaaatcagatttcctccgactaaaatcataagcggcagtccaggggagccggatgtcaccaaattataaatcagccagattcctaaacatattccataatataagtgcattgccttctcgggattgtcgcgcagcaaacttcctttaataatctttttcatcatatcgcccctataaattttaggatttccctttagtttacatgcatcttcggttcatctcaaaatttgctctttggcttttgatgctctcaaaatatttcgagggaattttagaattatttttttacagatatgttttctgatagctctgcccacttctatcatctactatctcccttgctaaaacactgttttctccatataaacaaggaaagaccttctgtagcaagccacctatttagtccttttatttcctcttgggaggaatgtctcactttctatttcggctaatactcccatagaatcaacaaatgtaatacttgtttcattttcacgcataagaattttcgtacccccacttaatagaccctgtcatttctcagctaagtctgttgttaacttgccaatatcttctgcagagatgccgtaccatccaacaattcgttatgaatcaacctattctgaaattggtcagagatctctagaatacccaagtaacttgtgattttactttctaataattggaaccactgatctttttcactcaatgtatcttctatatatataaatttgtacatgtatttacctcaattcattcatttgttttatttttatttgaaaagtaaaaagaggacattaagtcctcttcttacttacgatatgtctattagtatctttcatttacacgtgtttttgatgctttgttttcaaatgaaatagggtcttctgttttagttctcctaatctttacagaaatacctactagaatgaccgccatagttgtaaatattcccatggttaataagatcgtatcctgatttaaactccatccaattaagaaagagatgatcgctcctccgaaacttgccgaagcaataaataaacttgtaacttcgtcaacgtacttctgaataatgattgatgctagtgttaaagcaatgggaaatatgcccgctatacttaggccaatcaaaaatgtaccactcaattgaagtaatgggttacttatataagagaaagcaatcaacaaaacaattaaacaactacagctaaaaaggaggtatttagaaaaatcaagccttctacttacgaaaccaatcaatattcttcctatgatgatccctacccagaaaaaggagacacttataagactaatttgttcattgtcttggtttatcatgattgaaggtaaaaagttggcaaaatttgtttcaattccagcatataggaaagcgaaaaatacaaaaaagcctaattgctttgatttttttctatctcctataaagtattgaaatgctcctccatctggaaaggtcacttgttggttagcattcttagcgtactctcggttcttagacaagaaaattaaccaccctacgaataggacgaataaaaaggtgaatatacagtaatacggtaaaaaccagttattgatatctatgaaggaattaattaataatgggaaagataaagcgcctaatccaaagagaacttccagcttactcattttttctgcattactttcgaaattagcaataacaaatgaaccaactgtcgtttctaatgtgcctgccccatatcctaagagaaaagccattacaacaatataataccaatccttagttagaaaaaagatacttaacgctacaagcattattgtcaaagctaaagtaagtgtcctaaaatgactgtatttcttaatcattaacggtgcgattaatactccgcttagaaatccggtaaactgaaagaagattatgaccgaaatatcatctgttgtcttgttaaaagcctctaatagaaatggtgtcaaactccctgttgatatatggataatacctactgtaaaaaagaaagcatatccgaataaatatgtccctcttaacattcattacacccctatatgaaaaagcaggaaagtaaattcctgcttttttagtaacttctctctttgaaatactagttgactgctgaaacagacattggttgagagttgctgtctttctcaaagaacatttctaacacttcctgagatctaaaaccatcactaaaagaagggatctcaacccaatcattctgagttgatgcaatccaattgattaactcgcttctaaaagaatcagcccatccataaaactcgtttggcggatcgtttaataggctttgcggtactgggcagtctaccacgttcaagccatctatgagcttgtaaacgtgaggattacctgtgtggtatttaaactcttttttgtgtccaactacctcaatgctaaaaccacagtcttcaggtgcagaacattttgatgtgatgatatttacaaataccttgttcttcagctggccataaatttctgcatagtcatctactagtacctgtttatcctcttttgtttttacatttgtgttcatctttgcccttactgattctgtgatgaaatcactctcaaacaaataccataccatgtcgataaggtgaatacccagatcccccaatgaaccactcgtcttcctactgttagcgtcatctctccaagtaaatttcttgcgtctaagtgcactatttttcttgaagtgtacttttatggacaggatgttacctagttcattattgataattaagctttttaagatatttacgtaagataaatatctataattaaatcccatactggctcttacgctcaacctttcagcagtatctttcattatgcttgcttcttcaagagaaatagccataggcttttcacacaaaacatgcttatgttttcctaatgcttgcaaagcatgttctttatggcaaaagtttggtgatgctacaattaaaccttctgaggcatcaattagttcatctacgttttcaaatgacttcccgccgaaagttttcacaaagctttccgcattttgttgatttatgtcatatacccctactaactctgcattttttattgtagataaagcagttgcatgcgctcttgcaataccacctgcacctatgatgccgatcttcttcatttttatttcctcctcatgatccaattaatttttttaaggtattagtaattccttttgagtactcactatcagttataaggtggtgcaagtttttggcttcctgtgttgcatttttgagcagatatccattccctactgtctgtagcatacgaacatcatttccactatccccaaatgcgatagctctttcggtatttaggttgtatttctctaacataaacgttacaatttcattctttcctgtccctgtggggataaaatctacatcatagctgtcttctggatcgcctgctaagggattacaccgatttatatttactgaaacgccgtattcctcgcagattttttcaattgctaataggtttttcttgtcgtttatttcatcttgttcctgatagtagaagttatgcttataccgtgactttcctaattgagtttgaggattcaaaagaatgttatgattttcatgtagctgtttcacaagtttttcaaccttttctttactaaacccatcatttatgcgactgttccacttattatcttgctgaccgaagttatgctctgaaaagtacgtaatttcagttccaagatcactagctataaaatgcggaaaatatctaaattttcctcgtcccattttatcgataatagattctatactgctcccagtaacccatccgattattagttccccatctttacttttttgttctagatagtcttcgagttcataaatgtcttgttgtttttgttcgtcgattgtatgcggaaaatacgtttcatcaaaatcacaaaaaacaatatactgaggatgttcaaccgtggataacgttttatactccgatttcttgcttaataacatgaaacagtccctccattactctgtcttgttcttctaaagtaaatgacggatataaaggcaaatgcagtacctgactatgagccttttccgtatgaaccaattggagtcctgcatacttgtcctgtactaaaggagttttttgcatatgagacagtattggataatatacatctgtttgaacaccaaaatcttcatttaatttagtcatgatatctgctctatcttctgttctcaccttaataggaaacagatgccatacatgatcttcacttaattctggtaattcaataaagcctttattctgcaactctgctaattgggtaatgtatctatccgccaagaacagtcttttgaagttgtttaatgaaaggtacttcattctctctaaaccaattgctgcctgtaaattgtccatttttgaattaaatccaaaattgatgactttcttatttttcacatttacttcaaaaccatgataactaaattgaatgcattttttagcgagttcttcattatcagttgctattgccccagccttgccacatacaccaaaattcttatagggattaaaacttaatgtagtgatgtctgcatactttcctaagtctgtcagtccaattccttggcaggcatcttcaattactttcaatttataacgatttgcgatttgtcggatatgctgcatgtctgaatgttttccgtataaatgcacaggtagaataaactttgtataaggagttattgcttcttcaattttgtcaggatcgatgcagaatgtttgtgggttaatatctacatagataggaacgcctcccaaagctaacacagcattttcagtagctgaaaagctattagccggcatgataacttcatcccctgggtttaaccctaaagccaataaacctatcataatagcatcggttccactgctggttgcaattacataccttttatgtaaatatgtagataaaactttttcgaattgctctaaatagggaccactcgtaaattttccagttggcaaaacttcagttaatgtatttaagatatcttccacttcatcattggttattaatctgtctacaggcaaaaaagggactttactgatttcacgatttttttgatagttgaaaagatcatgttcaatatctatcttttcctttaatacttgtttccactgctcgtttacaatactgtcttcaataacaagttcttttccttgtacgtcaccttttaagtgttttaatagtgacatgttttctttgcttttacctgaaatcttaacctgtttttgcatgaacagtacctccaatgattttataatctaaaaatttattacaaatttatcctaatttctgaaatcggtaacatgtcaacaacttttttaaggaagggaaaatatgcctacaattgatgaaatagcaaaattatgcaatgtgtctaaaaccacagtgtcaagagtattgaataatcatccttatgtgtcgaaagaaaaaagagatatgatcttaaaggctattaacgaacttgactacactcccaattatttagctcggaattttaggagaaataagacacaaacgatagctttatcggttccgagtatcgaccatccattttttgctcaattaataaaaggggtctctcatgaagcactgtttaagaattacaaggtaattgtatttcagaccttttatgacaaacagacagagctagaattattagagttattgaaacataaagaagtggatggtattattcttggaactttagaaaatgaatgggatcagatatcccctttcttaaagtatggtcctatcttattatgtaatgaatatcatcactcagcggacatcacgataattgggtatgatgaatttgaagctacatacatgggggtagtacatttaattgaaagagggcataaaaaaattgggttttgttttgatactccatatagcgaagctcaatgtcagaggaaagagggttacttgaaagctttacaagattacaatttacatcatagaagcgaatggatattcggcgaaatgtttaatattgaggatggctttcgtgtttttcataagataaaggatctaaaggacagaccctcagcaatatttacaggaaatgatcaagtcgccgcagggattattaaacaggcgatgaaaaatggctttaaagttccagaagacttagctgtaattggttttgacaaccaattgatctgccaagttgttactccgaccataacaacaattgatattcccgtaatagaattaggccaacaggctgtgttgaaaatcatcgagtccatttcgggtaatgcctctttaaacagaagaattattaaactgccaacaaagcttattataagagaatcaacgtaacgatagatttccctttatcattttatatctttatataagaaaaagaggttattcattttaacctctttttcaatagtaagtcgtcaattatttctttcatttcaccctctggcagcactcacttcaaatctgatccattaacaacgaaatatccacttatatttccccatctcgatggtttgcgaattaaaagttcttgaacccttttttcaactaggcattactgccgctgatcgagctctttttgtcttttttttcaccatgaagatggtgaagcaggcgataaaacggcggcagcagggcaataaccagaatgacgcgaatgacctgaaccgcaacgacaaaggtggaatcagcatgtaaggtaactgacgtcgtcgccatctctgcaatcccgccgggcgcaaatgccagaacagaagtgatgagcgaaattcctgtcagctcggaaacgatcacggcgctcaaaaacattgctgcgatcaaaccgacggacgagacaaacccgacgatgataatacgggtgacgccggcaaacatgcttttgtacatcttagagccgatcgttgccccgagaaatacttgtgatacatggttagcttgtgacggccaccatgccgtcatgtcgtgccctgtcaccgcagctccgccaacatgtacaattgctacaccgagcatgctgccgagcagccatggagctggaaattttaaaaatttcgcagctttgcaagctccccaggcagcgagaataagaatgacggtccacaaaacgggagcgagcctaaaatctgtcgttgcagaagaaatcgtctctgctgcggcacttgcggtacgatcttgttttgtatagatcagaatgactaaaaacggaatggaaagcaccacgagcagcacacgcatcatttgaacgaggctgactatagcggtattggcgcctacttcctgtgcgatgctcggcatggcggaaagtccgccgggagcggtgccgacaaagctagtcatcatatccgttttgctgaaacgccaaagcacatatcctgacagcatagccagcaggatagacaatatcagcataacgccgactgaaaaccaatggtctttgagaacagagagaacggataaattcagcttttggcccaattcgatgccgaggatcatctgcccgagggcgagccatcgtcggttaattcctttttggtctggtgccatcatcagccatgccggccgtatcatggcgaggcagcaggcgacaatcagtgttccgatcatccatccaattgatattccggttaatgaaagaataaacccccggctgcactgattgcgataaaccatagatctttgaggagattttcgtctttcttcaatgtaaaacccttcttcctttttcacgtaacactccaattgttcacgtagtgaatgtatttattactatagtatatttttgttgataaagaaattatgaattattttctataagcgattcacttttcttatgaccttgtgttcgagcttttctattgtgtaagtcagagataaacccgctgtcagcagacacacggcaagagcgtaaaaaatcacttctccgccaaatgatgtcaggatcagcccgcctgccagcggtccgattgagcgggatatatcccaatgcagaccatagacagcataaaaccggcccagcaaatgaggcggcgccaatttcgatatgaaggtctggatgtgggttagcccgatgctttcgccaaccgtcatcaccgctgccgtcactaaaagcattgtcagggaggttgagcatgcaaaaccggcagccgcaagggagtagcaaatataagtaatgaagaggatcgttttcattgaaagcttttcggtccctttgacaagaggtacttggagaacacagctgaataaagcttttgctgctgaatagatggtcagcatggacagataatcagaaaacatgtttttgctgaacagcctgtatgttgtttctgtttgtgcatataacatgctgatggggagagaaagcagcaaaagaagcaggacaggcctgtatatcgtaaagctcgcggacattttcggggtaacagctgggtgtagcggctttgtctcaggcagtttcagtgcagcgatcagaaagtagataaacaatgctgcggcatctaatgcgaatatccacacggggttatgattgtacagcagcatccccactagcggccctgccgtcagtcccgccgaatagatcgcattgatgaccgcaaacacttccgaacgtctgctttccggcgtgctttcggcgatttgggcgcgggaagcgggaatgtacaacgatcttccgatgccattcatgacatagagaatagcgaaaacatacgcatgctcagcaaatacaaaccctgtcattgccgctgattgaagaagcaatgcggtcaaaatcgctgtgcgccgcccaatccggtccgccgcctttcctgcagcgagcgtcaggaaaatatcagcaaatggctgaaggctgatgatcagcattggcatcatgatactgccgtttaattgttcatgcagatacagcaccataaaaggtcccatcattgcacctgtcaggcttgtcagcaattcgccgaaaaagcggagccgaacgggagcggtatatctcgattttatagagtgaaaactggtcaacatgtgatcgccgcctttcgctgtttgatatagtagtagtgtatagaaggggcggcggcccaaaaagtgaagaaaagaagagataaaagttccccttttgtcgggaggtgcggggattgaagctgatagagcactacgtggcgcttgtaaaaacaggctgcgccgagtatgggcaaatgaacgaaatgacgctcactgagattgctaactgtttattttgtacagaaagaaatgcaaagctcattttacataagctggagaacaacaattggattatccgggaaagcggggcggggcgcggccgtaaatctaaaatcgcgtttcttcggaggcctgaggaattgcttcttcaaactgccaaggaatataccatgtcaggaaagcttaaaaaggcaaaggagctgcttcagcagtatcagtccgtgtttccagggcttcaaaacgaatataacatgtggctttcagaggtgttcggatttgtgacggagacgggcgagaatgggacgaaggatgttctgcggctgttcatctcgcctgaatctgtcagcagtttggatccatgccaaatatttttgcggtctgagggccatttcgtcaaacagatatttgatacactcttgacgtttgattcggatatacaggagctgaagcctcatttggttcatggatgggaagaggtcgaaaaaaaacaatggagattttttcttcgaaaaggtgtgtcatttcataatggacagccgctgacatcgcgggacgttgcgtttacgttttagcgctttttggaactgggtgacaacccgtataaatggcttctgcacggagtgaaacaagtcttagaaaagggcccttattgtgtggagctcatactcgataagccgaatgcgcttttgccgtatgctctttgtgatgaacggctgtccatactgccggcagaacagggcggcgggaaaaatggaacagggccttttcaggtgaatcagcaacacagcgggatgcttgtgcttgaagccaatgagcgctacttcaagggacgcccctatttggatcgcgttgagtttgtgttttctgagcaagccggagagatgaacggttttaccattcaagaaaaacaaacatgtcctgagcagcaaactgtttttgatgagcggcatgttcagtatttgtcgcttaatctgaaaaagaaggggcctcttcagcaccgaagctttagaaaagcgctccggctgctgatttcctctgaacggctcgttcgtgaagcgggagggcaccgaagaatcccggttacgtcctttttgcatccgagtccttttgagtgggagggcgtttcgccatctgaattgttgaagaaaagcggatacgagggcgaaacaatcgtgctttataccttttcggaaacggatcatcgtgaggacgccgaatggattcaaaatatttgcgcccagcacggtatcaggcttacacttcaattctgtgattctgctgatctgcgacggccggaaatcgtgcagatggcggatatcattcatgacagtgcgacgttttatcaagacagcgagcttggttttctgcatttgctgctgtcggagaacagtttcttgtatcagcatctatctgaaaagctgacacagatatgctcaggaatgacggagcagatgttttccatgcctgaccgctgttcgagaatcgacatcctgcgtgacattgaccggcagatgatacaggagctgaatgcgattccgctgtatcaaaatgtgctccaggtgacatcaagtaaaaatgtaaaaggcctggtgcttgatgaagagggatggattgatttgtactccgtatggctgtccaaataaaaagagggttcttttttgaaccctcatttttacgctgccatgctgcggcattgttcagcacaggcgaagcaggctttcgcacatgcttggcaatgatcatgatcgtgctttccgcattcagtgccgcatgcttcacaaatatcggcgcaaagtgcacaaatttctttcataaacgggctgtccgtttgcatggctttgaccgccagcgcgcaaatatccgcgcattccctgtcaagccggatgcatccgctgagatgatgctgcatgctttcttccaagcatttagtaaaacaatgattgcaagccttcatacaatcgatgcaagcctcaatacaagcttcagaatattgctccatggttgattccccctgtatgacagtatatggttttatgtttcccggctgcatttgaaaaaaacaggggagtgtgtttttagctgaggtgatatgtacatataccctgaacgggtatatctaacgttccatcagatagtataggaaccagacagcgtgattttgttcatcacgtgctgcgcgtgtaaagacgcctttcgcttttaagtttgacgtttcctcggccgcacgcaagtaaaagtcgacggtttcttgttcatctttaaaagcggcgtccagtcctcttgtgaaattgtccgggcattcttccgtttgtttcggcatgatgtgtttgccggtaattgaaccatacagtgtggaaaattcacggaggtggcgaatctcgtcacgcctgatttcttcaatctgttttctgacctcatcgctgtgggcgagttcggcaagcttgcggtagcattgaattgcactgaattctccgttgatggccttctgcaaattccgaatcaaaacaggatcttccctgtatggcaccggatagggataatagctgtaatgcaaggggattcaactccattcttaggaattgggcttctgtaaaagtatatgttgggcagggagagatgtgcggagataatcagctttttatatgtgaaaaggccgtttttaccaatagatcagattggtcattttcgtcaacattcgataaaatatatagagataaaaagagaggggtcttctaatttgggagcagagtttttagtaggcaggtccgggagtggaaaaacgaagctgatcatcaatagcattcaggatgaattgcgccgggctccattcgggaagccgatcatttttctagtcccggatcaaatgacgtttttaatggaatacgagcttgctaaaacgccagatatgggcgggatgatacgcgctcaagtgttcagtttttcacgattggcctggcgcgtcctccagcatacgggaggaatgagcaggccgtttctgacgagcaccggcgtacaaatgctcctgcggaagctcattgaggagcataaacaggagttcaaagtctatcaaaaagcgagtgacaaaagcgggtttaccgcacaggttgagcggatgctgacagagtttaagcgctattgtctggaaccggaggatatccgccggatggcggaaagcggaacggcttccgagtatcgcggagaacgtgttttatctgaaaagctccatgacttatcaattctgtatcagcaaatggaaaaaagcctcgcagaccaatatcttcattctgaggattatttgacattgctggcagagcatatcccgcttgcggaagatataaaaggcgcccatatctatgtggatggcttttatcagtttacaccgcaggaattcagggtgttggagcagcttatggttcatgcggagcatatcacgttttcgctcacagcggacaagccgtcatatgagcgggagccgcatgaactggaattgttcagaatgacggggaaaacctattaccgcctgcatcagaaggcgaaggaactgaatctggacattacgtataaagagctgagcgggactgagcggcatacaaagacgccggaattggcgcatctagaggcacagtatgaagcgcgtccggccgttccatacgcagaaaaacaagaagcccttactgtgatgcaggccgcaaacagacgagctgagctggaaggcattgcccgggaaattcacgccctagtcagagagaagggatatcgctataaggatgtagcaattcttgcgcgccagccggaagactacaaggatatggtgaaggaagttttcgcagattacgagattccttatttcattgacggaaaagcatctatgctgaaccatccgttaattgaatttatccggtcaagccttgatgttctgaaagggaattggcgttatgaagcggtgtttcgctgcgtgaaaaccgaactgctattcccgctcaatgaaccgaaggccaaagtgagagaacaggtcgatcagctcgaaaattactgtatcgcctatggtattaaaggcgaccgctggacaaagggcgatcgtttccaatacaggcgttttgtgtcattggatgatgattttgcacagactgatcaggaaatcgaaatggaaaacatgttgaatgacacccacgattggattgttccgccgctttttcagcttcaaaaacgcatgaaaaaagcgaagacggttcaagagaaggcagaggcgctctatcgttatttagaagagacagatgtgccgctgaagctggatcaggaaaggcagcgtgctgaggatgacggcagaatcattgaagcgcagcagcatcagcaggcgtgggacgcagtcattcagctgcttgaggagtttgttgaaatgatgggagatgatgagatttctcttgatttgtttcagcaaatgatagaagccggcgcggagtcgcttacattttctcttattccgcctgcgcttgaccaggtgtttgtcggcaatatggatttgtccagaatgtatggcacctcctgcacctttgtgctcggggcaaacgacggcgttctgccggcacgccctgatgaaaatggggtcctgtcggatgatgaccgggaatggctgaaaacgattggggttgagctatcctcaggcggacgggagcgtttgcttgatgaacatttcctcatctacatggcgttttcaagtccgtctgaccggctttacgtatcgtatccgattgctgatgcagaaggaaaaacgcttttgccgtcgatgatcgttaagcggctggaagaactgtttccatatcataaggagcgcctgttaacaaatgaacctgaacaggtcagcgatgaggaacagctgatgtatgtcgtgaataaaagcgtggcacagtcctttaccgcgagccagctcaggttatggactcgggaatacgacatcagcgacgtctggtggagcacgtacaatgtgctgatgagtgagccggacaagctgcaatcgaaaaagctgttctcaagcctgtttttccggaatgaagtgaagcagcttgaacgcagcgtgtcgagacagctctatggtgaacgcattcagggcagtgtctcaagaatggaaacctttaacgcatgcccgttttcccattttgcgtcacacgggctgcatctgaaggaacggcaattcttcaagcttgaagcaccggatatcggccagctgtttcattccagcttaaagctgatttcagacaggctgcgtgagaaaaagctggattggcgcgatttaacgaaagagcaatgcgagctgttttcctatgatgcggtagagcggctggcaccgaaactgcaaaaggaaattctgctcagctcaaaccggcattattatgtgaaggaaaaactgcaaaaaattgtgacacgtgtatccggcattttaagcgagcatgcgaaagcgagcggattcgtaccgatcgggcttgaactgggctttggaggaaaagggccgcttccgccgctgacctttcaactgaaaaacggctgtacgatggaactcgtcgggcgaattgaccgtgttgataaggctgaaagctcaaaaggcctgctcctcaggattgtcgattataaatcaagcgacaaaggccttgacttagcggaagtatattacggattggcactgcaaatgctgacgtaccttgatttatcgattacacattcagctgactggctcgggatgagggcgacgcctgccggagtgctgtatttccatattcatgacccgatgattcaatctaatctcccgcttgggcttgacgagattgaacaggagatctttaagaaatttaaaatgaagggcttgctcctcggtgatcaggaagtggttcgcctcatggatacaacccttcaagagggacgttcaaatatcataaacgccggcttgaaaaaagacggatctcttagatcagactcggccgcagtcggtgaaaaggaatttgatcttttgacaaagcatgtgcgccgcaccttccaggaagcgggcgaacaaatcaccgacggacgcgtatccattgagccttacaaaatgaagaacaagacgccgtgcacatactgtgcgttcaaatcagtatgccaatttgatgaatcactggaagaaaacgagtatcgcccattaaaggctgaaaaggacaagacgatacttgagtggataaaaaaggaggcggatggcaatgaacattcctaaaccggcagacagcacatggacatatgaccaatggaatgccattgtttcaaccggccaggatattcttgtggcagcggctgcgggctctggtaaaaccgctgtgctcgttgaacgaatgattcggaaaatcaccgcggaggaaaacccaatagatgtagaccgtcttctcgttgtgacatttacaaacgcctcagcggcagagatgaagcaccgaatcgcagaagccttggaaaaagagcttgtacagcgccccggctcgctgcatatcagacgccagctttctcttttgaaccgggccagcatttcgacgctccattccttttgcctgcaagtgctgaagaaatattactacttgatcgatcttgacccgggctttcggatagctgatcagacggaaggtgagctactgggggatgaagtgcttgacgagctgtttgaagacgaatacgcaaagggcgaaaaggcgttttttgagcttgttgatcgctatacgacagaccggcatgatctggatctgcaatttctcgttaaacaggtgtacgagtattcccgatcccatcccaacccggaggcgtggctggaaagttttgttcatttgtatgatgtatcagaaaagagcgccatcgaggagctgccgttttatcaatatgtcaaagaagatattgcaatggtgcttaacggggcgaaggaaaagctcttgcgcgcgcttgagctgacgaaagcgccgggcggcccggcgccgcgtgctgacaattttcttgatgatcttgcgcagattgatgaactgattcagcatcaggatgatttcattgaactatataagcgggtgcccgccgtctcttttaagcgtgccaaagcagtaaaaggggatgagttcgatccagcgctccttgatgaggcgacagatttgagaaacggcgcaaaaaaactgcttgaaaagctcaaaaccgactacttcacgcgaagtcctgaacagcacttgaaaagcctagccgagatgaagcctgtcattgaaacgctcgtacagcttgtcatcagctatggaaaacgattcgaagctgcgaaacaggaaaaatcaatcatcgatttttctgatttggagcattactgtttagcgattttgacagctgagaatgacaaaggtgaacgtgagccgagcgaggctgcaaggttttatcaggaacagtttcatgaggtgctcgttgacgaatatcaggataccaacctcgtgcaggaatcgattctgcagctcgtcacaagcgggccggaggagactggtaacctgtttatggtaggagatgtcaaacagtcgatttatcgattcaggcttgcggagccgcttcttttcctctctaaatacaaacggtttacagagagcggagaaggcacggggcggaaaatcgatttgaataaaaatttccgaagccgggctgatattttagacagcacaaactttttatttaaacagctgatgggcggcaaaatcggtgaggtcgattatgacgagcaggctgagctgaagcttggtgcagcgtatccggacaatgaagagacggaaacagagctgctgctgatcgacaacgcagaagatacggatgcaagcgaggaagcagaagagcttgaaacggtgcagtttgaggcaaaagccatcgctaaggaaattcgcaagctgatttcatcgccatttaaggtgtatgacggaaaaaagaaaacacatcgcaatattcaataccgagatatcgtgattttgctccgttcgatgccgtgggctccgcaaatcatggaggagctgagagcacagggcatacctgtttacgccaatttaacgtcaggctattttgaagcggtcgaagtcgccgtcgcgctttctgtgctgaaggtgattgataatccgtatcaggatataccgcttgcctctgtgctgcgctcaccgattgtcggagcagatgaaaacgagctgtctttgatccggcttgaaaataaaaaagcgccgtactatgaggcgatgaaagactacctggctgctggtgaccggaacgatgagctttatcaaaagctaaatacgttttacggacatctgcaaaaatggcgcgcgttttcgaaaaaccactcagtatctgagctgatttgggaagtgtaccgcgacaccaaatatatggattatgtcggcgggatgccgggcggaaaacagcgccaggccaatttgcgtgttctttatgatagggcgcgtcaatatgaatcaacggcatttcgcggcttgttccgtttcctgcggtttatcgaacgcatgcaggagcggggcgatgatcttggtacggcgagagcgctcagcgagcaggaggatgttgtccgcttaatgacgatccacagcagcaaagggctcgaatttccagtcgtgtttgcagcgggtctcggccggaatttcaacatgatggatttaaataaatcgtacctgctggacaaggagctcgggttcggcacgaagtatattcatccgcaattacgcatcagctatccgacacttccgctcattgcgatgaagaaaaaaatgcgcagggagctgctgtcagaggaattgcgtgttctctatgttgcattaacgagagcgaaggaaaagctgtttctgattggctcatgtaaggatcatcagaaacagcttgcaaaatggcaggcatccgcgtcccaaactgattggcttctgccagaatttgaccgctatcaggcgaaaacgtatctagatttcatcgggccggctcttgccaggcacagagacttggaggatttggctggtgtgccagcacacgctgacatctcagatcacccggctcgttttgccgttcaaatgatccattcctatgatttgcttgatgatgatctggaagaaagaatggaagaaaaaagcgagcgcctagaagcgatccgccgaggtgaaccagttcccggctcgtttgcgtttgatgaaaaagcccgcgagcagctgagctggacatacccgcatcacgaggtgacgcaaattcggacaaagcaatcggtttctgagatcaaaagaaaaagagagtacgaggatgaatacagcggcagggcccctgtaaagccggctgatggaagcattctgtacagacgtcccgcttttatgatgaaaaaaggcctgacagcggcagagaaagggactgccatgcatacggttatgcagcatatcccgctgtcacatgtgccgtcgatagaagaagctgagcagacggttcataggctttatgaaaaagagcttctcactgaagaacaaaaagacgctattgatatagaagaaatcgtgcaatttttccatacagaaatcggcggacagctgatcggtgctaagtggaaggaccgggaaataccattcagcttagcgcttccggccaaggagatctatcctgatgcacaggaggcagatgagccgcttttagtgcagggtatcattgactgtctctatgaaactgaggacggattatatctattggattataagtcggaccggattgagggcaaattccagcatggatttgaaggagcggtcccgatcttgaagaaacgatatgaaacgcaaattcagctgtacacgaaggcagtggagcaaattgcaaaaacaaaggtaaagggatgtgcgctttatttctttgacggagggcacattctgacattatagcgagatccataagctccggaatttcaggcggagcgggtctcgttttctatataaaagagaggtgaaagcatttgcggattttacatacggctgactggcatcttggaaaaacgcttgaaggaagaagcaggcttagtgaacaggccgatgtgctggatgaaatgaatacgattgtaaaggatgagcagatcgatgccattgtaatggcgggggatgcatttgacaccgtaaacccgccggctttagccgagcagctgttttatgaaagcctgtctgcgcttagcgacagaggaaagcgcccgatcgtagtcattgccggaaaccacgataatcctgaccgtttgtcagccgcttcaccgctgacacatgaaaacggcattcatttaatcggttatccgacaacagagccgattcatattgaagtgccttcagcaggagagcttttggcggttggagcgctggcgtacccatctgaagcgcggttaaatgaagtgctatccgatacgtttgatgaaaagctgctccgtgatcattatgacgtgaaaatcaggcaggcgtttgaacatatgacaagccggttccggaacgatgcagtgaagattgccgcaagccatatttatgtggcaggcggaaaccaaaccgattcagagcggccgattgaagtcggcggtgcatacacggtggctgctgaaagcctgccggcagatgccgcttacgtggcgcttggccatttgcatcgcccgcaaacgatcaagcgggcgcggacgcttgcgcgttattcaggatctccgctcgcctacagcttttctgaagcgggctacgcaaaatcagtgacgattgtggacgcaaagcctggggaagaggccacttggcaagaggtgttattatcaagcggcaagccccttgtgaagtggaaagcggcaaatggattaagtgaggtgtacagctggctggatgaaggcagagatcagaatgcttggattgacctggaaatccgtgtcacagaccagctgtcacttgaagagattcacaggctgcggaaggcgcacccaggctttatccatatcaggccggtttttgaagaacagaacaaagaccgggaacggatcgaggttaaacatgtctcaatcgaggaccgctttaagaaattttatgaaaaacaaactggcggtgcggtgccggatgaagaaatggtgaagctgtttttagagcttgcatcaggcgttgaagaggaggatgcgaaatgaagccgatcgctttaagcattaaggggctccacagctttagagaggagcagacgatagattttgaaggcctttccggtgccggtgttttcggcattttcggcccgacaggaagcggtaaatcctctatactcgacgcaatgacgcttgctttatacggaaaggtggaacgggcggcgaataatacgcacggtatcttaaaccaggcggaagatacgctgtctgtttcctttacctttgcgcttcagacgaatcaccaaatctcatacaaagtcgagcgtgtgtttaagagaacggatgaaatgaaggtaaaaacggcactttgccgcttcatcgaaatcaaggatgagcataccgtactggctgataaagccagcgaagtgaataaaagagttgaggagctcttggggctgacgatcgacgattttacgagagcggtggtgctgccccaagggaagtttgctgaatttctgtctttaaaaggagcagagcgcaggcatatgcttcagcgtttatttaatttggagcaatatggagacaggcttgtgaaaaagctgagacggcaggcgcaggaagccaatgcgagaaaaaatgaaatgcttgctgaacagtccggtcttggtgaggcgagttcagaggcagttgagcaggctgaaaaggctctcgaacaagcggaagcccggctggaagcgatgaggaagaaccgtgatcaggcgaaggagcggtttacagagcatcaggagatatggaatgtccaaaaggaaaaatccgcttatgaagaagaggaaaaacgtctcgcagaagaacagccgcatatagacagcatgcaaaaacgcctgctggaagcagaaacagcagcagcccttaagccctatgcggaccggtacgcagaagcgatccagcatgaggagcaagctgaaaaggaacaaacgctagcccaaaaggatttagcagaccggacagctttctttcagcaaaaacatgaagagtatgaagcgtggcgccagcataaaagcgagaaagagcctgagcttttatccaaacaggaacagctttcacgcttgcaggaaatcgaaatcaaactgagtgaggccaagcaagaggaagagcgcaaaaaggctgacctccggcagaaagaagaggctcttcaatctgtcatgaatgaattggagaccgtaacagaccgcctgacacgagggcaaaacagacagacagaattgaagcagcagctcaaatccctgcaggtgacatccgatgagcgaaaaagctgccagcaggccgcagaaatggcattgcgcatcagacaaaccgaggagcaaatcaaaaaagagaaaaacgaagtgacgaattgaacctcgtgcttcagaagatcaatgaagagaagaatacactcgttcaaaagacggaagcggaagaaaacaacatcattcaggcatatgaggcagttcaaactgtgtaccatttggtgtgcgaaacggaacgctcattaacacgtatgacggaagagactagaaagagccaacacacgcttcacttacagcgtgaaaaagcaagggtggcactgctgacaaaagagttagcccaaaagctgactgccggtaagccttgcccggtatgcggttcaaccgatcatgatccatctgcctcagtacatgaaacatatgaagccgacagccatcttgaagaggacattaaacagacagatgtattattgacggaagctgcagctctcagccaggagattctttcagccaaaattacgcttgaagaacagtccgcgcgctttattgaacagtgtccgtttttgcagacaattcaagcgcagaaccttgaagcggcagcttccttcgaacatcagccggtgtatgaagcatttgaaactgccaaatttgaatggaaacgaatcaagcaggacattctttctgttaagacacgaatggcacaaatgatcggcgcctatcaggagtctttaaaaaaggccgagcagcttaatgaaaaaatcggttttgaaaaaagagaagctgaccgtattgaaagcatcatcaccgagcttcaatcctcaatggacagcagtctgaacatgtttaaagaagcatttcagaatcaatctgtggacgaagcagaaaaatggcagcaagccattgaagaaaaggaccgggctgcagaagaatgtgaaaaacgaattgagaagagtatcgcgtttcttgctgagcatgaagcacaaaaggaaaaactgcgggaatcgagacaccggcttgagcgggaaaagctggagcttcattatgcggctgaacgcataaagagcgtgatagctgattatgagcacgaactcggagattatgcaaaaggagattcgattcaaatcaaactccgctctgtccagcaggatctaaagctgttaaaggaaaaagaacaatctttatatgaagaactgcaaagtgcccaaatgaagctcaaccaggcgaaaagccgcgcttctgcaagcgagctcactcttcaagaggcgaagggcagattggaaaaagcaaaagctgcttggcttgagcatacaaaaaacacctccattacccggactgaggaggttgaacaaagtctcatcccagctgatgaacttgaaaagatgaaaaccggcatagaccagtttatggataaactgaagcaaaatgctgcaaacttaaaacgagtagcagagatacttgccggcagagcattatcagagagcgaatggaacgaaaccgttgcagcattacaaaaagctgaggacgcatttggcgctgctatagaggaaaaaggcgcggcagcaaaagcactggctgtcattcgcgaccatcataaacggtttaatgaaattgaagctgaactgaaaaaatggcagacgcatatcgacaggctggacaagctgcaagctgtgtttaaaggcaataccttcgtcgaatttttagctgaggagcagcttgaaagcgttgcgagggacgcctcagcaagactcagtatgctgacaagacagcgctatgccatcgaagtggattcagaaggcggcttcgtgatgcgggatgacgcgaatggaggcgtaagacgcccggtttccagtttgtctggaggagagaccttcctcacctcgctttcacttgctcttgcgctgtctgcgcagatccagcttcgcggggaatacccgcttcagttctttttcttagatgaaggcttcggcacactggatcaagatctgcttgatacggttgtcacggccttggaaaaacttcagtcagacaatctggctgtcggtgtcatcagccatgtgcaggagctgcgtgcacggcttccgaaaaagctgatcgtccatccggctgaaccgagcggccgcggtacgcgggtatcacttgagttgatgtaagggaggagcggatatggcaaagcagactgccggaatatgtgagctgtgcggccggagcgatgtccagctgacagagcatcatctcacaccgaaagaggaaggcggagcgtttttgccgacagcgatgctctgtattccttgccataaacagattcatgccttatataccaatcaagagctcgctttacgtttaaacggaatggctgaactcagaagcgatccagagcttgcccggtttgtcaaatggatcagaaaacagccgcctgagaagctgatcaaaacaaagaaatcaaatgaacgaaaaaagaaaaaatgactaaaaagcagccctctctttgcagagcggctgcttttatccgtttccaaccatatcctgatcgttgacatcggggtctatataatttgtcgcgttgactgcattatttaatagaaggaaatctcccgtgtttcctgctcccgaaccgagcgcagattttgaagagcttttcggagaaaggtaaaaggaatcaccaaagtttacgactccgcccgatatggaattgatagctataggcccgacaattgctggcataaacgacaccctttatcgaagtctctgtttattatatgttcttggcgggcgattgtgagcgcggagactgaatctgtctgatatgtttgattctcgcatcaccgcggataagcgaagctgaaccagcatgtaaaacagaagaggcggaaaccccttgaattttgatgctgcgaacataaatagccggcacctcgtggcaaaatgcgctttgtacacctgtttcgcgaatcggcttcactgcctgctgctgaaagatttggtactcctttttgttaaatgagccttcattattgtaaaacgtggaccgagaacgctgaacagcaaatacttttacactcatatcgatttcatttgtgtcgccaacttgaaacacacttgcgatcccgagggaattaaacttaactagtctgatgcgtgatatgcgtttaagcattattctggcgcaatcggagcaaacggcccgatgataagagattcaggcggtgtatcaaaaatagaagacaggtagatggattcagtgtctccgatgtggaaaacggaggaactggacacaccgttcatccggatgtccccgacttccaagctgcggttgatgactgtaaagatcatgcttgctcatctcctttcatttctgatggaatatgctccagaaagtgttctacagcgcggatgacatcacgcttcacatgttcagcgatatgttctgcatattgtgcaggcggtgtattttcttcttttttgatatgggacatataatagtgaatccggctgtccatttgttttctgatgtcttcaataacatggtgtctgtttgtatcgtcaagtctgctgtcatattggttttcaagctgttccaaaatatctgggatttcctcagttaagtacatgtcgacattctggcggatctgctgcatgagctgagcgctctcttcctgctgcatcatcccgatttgcggtgtcgactggctgacttcaaagttttggacgctgttcgggtcagtcggatttaagccgatattcaaagtcccgtcgagcctttcgattttcagctgatcaaatttatactccacacgctcaatggtagtggccggccgctgtttcatcgtattcatttcagtttgaatctctttcagctgacgttcgagctgctgaatgtgaatcgcctgctgctgaacgaaggaattcaagttttgcaggtaagaggaaacagattgatcatacatgttcttcacctctttcatatgattaacggccaggaggctggagcgggaccaatgaacctgtgtcgggctcctgcagctggagcggttgccctgagccataaacttctggtgccggttctacataactccctgtattatacaaatttgacagtgacttgattgatccggcgctcccgatttgcagaatggaggaattactgattgattccagccggagatagttgatttgaatggtttgattaatatagaagttcatgtgcctcactccttttacgcattggccacgatcggctgatcaaccgcatcattgtcatacacattcgtcgcgttttgataattcatcaccttgaggctgtcgccggtattaaagctgccagcaccggcaaacgttctgacctgagcctgaggagaaatcgtaatgcagtccccgatgtgaacgactccgctcgtaccaatcgcattaattttaaacgctccgacaatggccggcatacgagcacatcctttgttgaaaaattaaaaaaagacaggtaaagtgaaataacaattctgatttcaattgggctattcacgatagcttatgacaaacgcacatatgtgtgagagaaatttaaaggggacatatcggctcttgatgaaagcgttttattttttcgggccgttatgtttaaacatggcaaaagaggatgttgggtataaattgagcggaaatgcggcgaaggatgccgctatccgcctatggtgatttttgtttatttctttggtgtttttgcgtgtagaatgctttttggagtatgtcgtgctgcggtattcgatttttgggcgggcacattctcgccctgaggtatatcccagaagtgctgagcaaaaagcggagttacatgtggtgtattctaagtgttatagaaaatgatttacatacgggagttttcaagatatctcccaaaaatcatttcttctttaatccgggtattcagcaggatatccagctcttggctgcattgaatcgtttcttttgaattcatgccatatttttgtgcggtttcaattagtgtgatcctcatttcttcaattttactgttcattacgctatctccaattctagattttattttgatataaatacaggatatcgttagtataacctattttggctcaaaaggttgcctttcgtcaatttgactaaaaaagcgacaatttttgctgcggccttttttaatggagaaaggactaaagtcttgctaagtgtgcttgcaaaaagtcctgccgttcctcaatttctctaagtatgtttgtctgctccttttcgatctgaaaggggctttttttgataaaaggatcatcagcagcactttgacaaatgtcaaggtgccattcgttgatgagaggagataatcgttcaatagtaaacgaccgcttcagcacgtttttcattaatgtgtgatattgcgaccggaaggcgggaatggatagaagccttgacgaaagcgtctttccttttgtcagaagcgggtcttcgtcataccattcttgtacggcaagcgatcttgtctctatcggggaaacgtaaagccggccggattcgtttaaacaaaatgtgtagtaaaagccttgattggtgcaggcgttgccgatcagccacaaaaaaaacagcttgacatccagatacaatttaatcctttcagccaattcgtcatctccggctgtgcggatcagtatgaaaaattcatgtaagaatgccgaggaatcactgttaaaaagggacaacggaacccttggatcggccgtcttcactccgtaactcgttttactggctggctgatggttcttgatgttcaaataaatgccttcaggctggccattgatggtcagaaagctgtacgaggcagcgggagcaggtacgccgatctggtcaaaaaaacaataggcgagtctgcgccgcatcagggacggatcatcctgttctgcattcaaaaaaagtgtcctttcaccaagcagagacttttcccagctgatttcgtaggatgccttttccgctctgtcacgctgtgtgagaagaatgggagaaacagatcgatctgttacgaaaagccccttggcagtacctttccttttcagctgctcccgatgaaaaaataaatgcacgcgctccatattctttcctccttctcaaaacgacatttgtatgatatgtagagcaagcccgtcctgaaacgaaatgaaaacggaattgagaaaaagggatttcagcattcgacagagaatacatgaaggagcattctgatttaaaagatgatggaggaataacatgaaatttgcgacaggggaactttacaaccgaatgtttgtcggcctgatcattgacgatgagaaaattatggatttgcaaaaggctgaaaaaaaactgtttgaacttgagacgattccaggatcgctgattgaatgtatcgcagaaggggataaattcgttgcgcatgcaaggcagctggccgagtgggcaaagaaaccgaatgatgagctgggatcatttatgtattcattatctgaggtgaagctccatgcacccattccgaagccatcaaaaaatatcatctgcatcggcaaaaactaccgggatcacgcgattgaaatggggagcgaggctgatattccggagcatccgatggtatttacaaaatcgccggtaacggttacggggcatggtgatatcgtaaagagccatgaagaggttacctctcagcttgattatgagggagaacttgctgtcgtgatcggaaaaagcgggactcgcatttcaaaagaagatgcatatgaccatgttttcggatatacgattgtgaatgatatcacggcgcgtgatctgcaaaaaaggcataagcagttttttatcggaaaaagcttggatacgacatgtccgatggggcccgtgcttgtacataaatcatctattcaggagccagagcgcctcaaggttgaaacaagagtcaacggcgagctgcgccaatccggttcggcaagcgatatgatcttttccattccggaattaattgaaaccctctcaaaggggatgacgcttgaagcgggcgacattattgccaccggtacgccgtctggtgtcggcaaggggtttacgcctccaaaattcttgcggtcaggtgacaaaattgatattacaattgatccgatcggaacgctgtcaaaccaaattggctgaataaaactggagggcggacccggacccgcccgttttttctgataatcatctttgtgacagaggacaagttcatggtactataagtggggtaatttatctgatagggggaacatatatgacacacctacatattacgacatgggtggtagcgctgattctgcttttcgtcagctactcgctgtattcgtcaggaagtgcaaagggcgcaaaaatcactcatatgattctgcggttattctatatccttattattttgacaggagctgagctgtttgtccgtttcgccaactggaacggagaatacgccggcaaaatgattctgggcattatcaccatcggcttgatggaaatgctcctcatccgcaagaaaaaagaaaaatcaacaggaggcctgtgggtcggcttcgtcattgtccttttgctgacagtgctgctcggtctgcatctgccaattggttttcaattgttttaatagaaaaacctatgaacccggctcattgatagagttgggtttttttatatttatccccttatattccaaatcatttaaaataaccttaaaattccctgtaagcggtatctcgtcctttgaaattatgataccttcaaggagattcattattttgcaggagggataacatgaaacgcagaaaattcagctcgtttgtggcggcagtgcttatttttgcactgattttcagccttttttctccgggaaccaaagctgcagcggccggcgcgatcgatcaggcggctgctctggaaaacggcaaagagcagacaggcgccatgaaggagccggaacaggtgaaatggtacaaagtgaccccgggagcaacggatattcagaaacactcacatatggcactgaccgtaaagagtgattcagtactgaatgtatctgtatatccaagtaaggaaaaagcgcttaaagatgaaacgtttgagatgtaccgttctttcacagcggaggatggaaaaagcgaagtcatttttccatacgcgtggagcggcccttactatgtaaaagttgaatacctcggagaagaagaaccagaggacggcggaacaacagaagcagttgcagaagccaagtatacgatcgggtataaaggcaccaaaaaacagccgtcagatttagaagaggaagaagcttgcccggttgaaatgagtgtcgatcagaagaaatcaggaaaaggcatcctggataaattgagagcgattcgtgatgagcagctgagccaaacagcagaaggcaaagaactgacaagcctttattacaaagcagcaccgtttatcgttgcaaagctcgcactcaataaaacagcaagaaatgaaatctatcaggatcttgtgacattaaagccgttatttgacgatgtgtcagaaaacggagcatcatcttcgtataagatcactgaaaaggatcaaaaagcgatcaaccggctatatgataaagctttacaatcagtcccgtcattccttaaagaggagataaagaaacaagcggaccgactaaatatgaagcagctgcaaggcaaaacagccggagccattttaacagaaaacaatattgcagcaaaaagtgaagttcagacaacaaaggttattttcaaggtgaaggacaataaaagcctctcatccgtacataatgaaatgaagggcttttctgcaagcgcgcaatcgaaaaaagacatatctaatgtgaaaaaggcaaagaaactgtttgacaatctgtattcatttgaacttccgaaagacgagaaacagaacggcgcatatacggcaagcgccaaaagggtcaaaagcgctgctgcgacactatccaagatgtccaatgtagagtttgcggaacccgtgcaggaatacaaaagcctggcaaacgatattcagtacccttatcaatggccgcttaaaaacaacggtgaaaacggcggtgtcaaaaacgcggatgtgaaatatgagcctgccaacacattgctgtccaaacgcaagcttaacgatacactcattgcagtagtagacacaggcgtagacagcacgcttgctgatttaaaaggaaaagtaagaacagatctcggacacaattttgtcggacgaaataacaatgcaatggatgatcaggggcatgggacgcatgtcgcaggcattattgcggcccaaagcgataacggctattcaatgactggattgaatgccaaagcaaaaatcatccctgtaaaagtgcttgattccgcaggttccggagatactgaacaaattgctctcggcatcaaatatgctgctgacaaaggagcaaaggtgattaatttaagtttaggcggaggctacagccgcgtgcttgaatttgctttgaagtacgcggctgacaaaaatgttttgattgccgcagccagcgggaatgatggagaaaatgccttatcttatcctgcatcttctaaatatgtgatgtcagtcggcgcaacgaaccgcatggatatgaccgctgatttctctaactatggaaaaggtctggacatctctgctccagggtctgatatcccgagcttagtgccgaacggaaatgtcacgtacatgagcggaacgtctatggcgacgccgtatgctgccgctgctgcaggattgctgtttgctcaaaatcctaagctgaaaagaacagaagttgaggatatgttgaaaaagacggcagatgatatttcctttgaaagtgtcgatggcggagaagaagagttgtatgacgattatggcgatccgattgaaattccgaagacacctggtgtagactggcattcaggctacgggcggctgaatgtcatgaaggctgtcagcgcagctgatttacagcttaaggtcaacaagctggaaagcactcaaacagctgtcagagggaacgcgaaggaaggcacacttatcgaggtgatgaacggcaaaaagaaactcggcagcgccaaagccggaaaagacaatgcgttcaaggttaatatcgcgactcaaaaacaggatcaagtactgtatgtgaaagcaacaaaaggcgatgcgaaaacatcgtataaagttgttgtcgtcaaaggaaaaccttccggcacaccgaaagtaaacgcggtgaaaacgaaggatacggcagtaaaagggaaggcaaacagcaaagcgatgatcagagtgaaaaacaaatcaaagaaggtcattgcttctgccaaagctgacgcaaaaggaacgttttcggtgaaaatcaaaaaacaaaaagccggaacggtgctgtacgtcacggctgcggatacggataaaaaagaaagcaaggaagcaaaagttgttgttgaaaagtaaccaaaaagcggtgctcgatgcaccgcttttttatttgcgcccccgttggactgctgaatacataatggatcgctttccgtttgaagccgtccattcaaaacggtctcctgtcccttcgctgctgtagtgatgctgcatcgcgcattgtgcggtgtcatttgaaaagtgataaaaggacacaccctgccccgccgaagtattcgaaaagactcctttattataagaaaagacgcaatcgaataccgataagccgaagctgtgcaagtgctgtagaaatgcgagaaaggtttcgtcgtcaagcgaatccaaaagcgccatgagcggccgcttgactgatttctcatagcggatgcgttctccgccggaaagggggatgttttctgcaccgcatgccaaaaccaacttgtcctgaaagccggcttgctcccactttcctttatgatggatccagattgggctgtgttggagactgtccgccagcagtatatcaccttctccgttttcgattaaacagatgccgtcttcgatgaggatggtgccgtattcccattttcgttcccctgtatatatcaattgtttccgtttcatccatgctgtctcctttttcttcattcctctcttttctttccaattcaagcctgtcccatacaactcttttatggacaaatcaactatctgcctatagatgcataaacttactaaggtgctgaaagaaacgaaattgttacgaaagaaacgggattggagctgatgtcacatgtgtggaattacgggttgggtcgattttaaaaagcagctcgtccaggaaaaacaaacgatggacagaatgacagacactctttccaaacgagggcctgatgattcaaacgtttgggggagcaccatgttttattcggacataaaagacttgcggttgttgatattgaaggcggacgccagccgatggcgtgtacctataaaggggatacgtacaccattatttacaatggcgagctttataacacggaagatttgcgcaaagaattgcgggcgcggggccatcaattcgagcgtacgtcagataccgaggtgcttctgcacagctacatcgagtggcaggaagactgtgtcgaccatctcaatggcatattcgctttcgctgtgtgggatgaaaagcgtaatctgctgtttgccgcgagagaccgtctcggcgtaaagccgtttttttacacgaaggaaggctcttcatttctcttcgggtcggaaatcaaagcaatcctcgcgcaccctgatataaaagcgcgagtggacagaacgggactttctgaaattttcggtcttggaccgtccagaaccccgggcactggcatatttaaaggtataaaagaaatccgcccggctcacgcgctgacattttccaaagacgggcttaatatttggcgttattggaatgttgaaagcgaaagacatacggacagttttgatgacacggttgccaatgtcagatcattgtttcaagacgctgtgacacggcagcttgtgtcggatgtgccggtttgtacgttcctatcaggcggtctggactcaagcgcaattacagcgattgcggcgggccattttgaaaaggaaggaaaagcaccgcttcatacttattcgattgattacgaagagaacgataaattttttcaagcaagcgcttttcagccgaatgatgacggaccatggattgaaaaaatgacagaggctttcggcacgacgcaccacaaatgcgtcatcagccaaaaggatctcgttgatcacttggaggaagctgtactggtcaaagacttgccgggaatggcggatgtcgactcatccctgctgtggttttgccgggaaatcaaaaaggactttgtcgtcagcctatcgggagagtgcgcggatgagattttcggcgggtacccgtggttccatacggcagatgttgagtctggctttccatggatgagatcaacggaggagcggatcaagctgctttctgactcatggcagaaaaaattgaatctgaaagaatacgtaaatgccaaatatgaagaaaccttggcagaaacgccattattagatggtgaaacgggtgtggataaagcaagaagacagctgttctatttaaatatgctttggtttatgacgaaccttttggatcggaaggatcgcatgagcatgggggcgagcctggaagtgcgggtgccgttcgccgatcaccggcttgtggaatatgtttggaatattccgtgggaaatgaaaatgcatgataaccgggaaaaaggcattttgcgcaaagcgcttgagggcattttgcctgatgacattctgtatcgcaaaaaaagcccgtatccgaaaacacaccatccggaatatacaaaaggcgtcagcgaatggctgaaaacgatcagaagccaaaaggactccgtgctccataccttgctggacagaaaacaattagatcagcttttagaaacggaaggctcctccttcaaggtgccgtggttcgggcagctcatgaaggggcctcagctgatcgcccatcttgctcaaattcatacatggtttgaagcgtatcgcattgatattgatgaaggataaagaaaaagccgattctgctcaaaggaatcggctttttcttcatatacaattgcgagaaaacataatagacttgaagaagcagtgatacataggagtgaaaagaaatgaaagagataatagaagcctatcagcaatgcggccagatcgtcagcgcccgcgaaccagcctgttacaaagcattttcgtttcttcctctgaagcaaaggcaggcagcttgggcggttatggcgttttgccatacggcagccaatgcggatgagaaggcgttatctgccattaaagctgaggcggaagatgttttttccggtacgtataacgggaatcattttttgtggaaggctttcggccatgcctaccagacatttacactggacagcgagccattccgtgagttcattgccgcacagaaagcggaagataaaccgtttggaaaccttgatgaattgctcatgcacgcataccagacaggcggggcagccggattgatgctgctcccgattatggcgcgccggcatcagaaacagctgacacttgcagccggttctctcggtttagcgattcagctgattcggattctgagagatatcggcactggccaacagcaaaaaagccgtatccctcgggaagtgatgcagcaacttggatatacagaggacgaccttcaaaagggcgtcgtgaataaggcgttcacaatgacgtgggagtatatcgcttttgaagcagaagcctaccttgaagagtgtcaggatgccttgccgctatttccgcagtattctcaaaaaccggtgaaagccgctcttcttttgcaccgggctgttttagaaaaaatccgggcgaagcagcacgatgtatttcaacatcacttcgctctcacagagaccgaagtgaagcagattctctctgatatctaaaaaaacacccggtcttgattgagccgggtgttacgccatacctttttgaatccagatacgtgagcgccatcttctgtacattaagattccccggacccattcatccgcgataaaagaaatccaaatgccggcaagaccgaaaccgaggtggatgccgaaaagataagcaagcgggagaccgatgccccacattgaaatcattgccatgtaaaccgggaatttcgcatcccccgcggcccgcagagagttaatgataatgacattaaacgagcggcctggttcaaggataatggtcatggcaatcaataggcttgcagttgctataatgtcagggctttgtgtgaagagtccgatcaggtcttttgaaaagatcgtcatcaaaacagaggtagccgcagcaattccgagtgcccaatataagctcttcatgcagcgctcataagcggcatcaaattgtttgccgccgatataacggccgattaagatttgtgtaccctggctgatcgcagtgccgaacagcaaaataaacatcgtaatattttgcgtatacacttttgttgtcaacgcctgcgcgcccatgatggcgataaaatacgtgacaatcatttgcgaaaggttgtatgaaagctgctctcccgcagaaggaatgccgattttcagcagcttgcgcaaatgctctttatgcatatgaaagacttttttcagcgacatcttcagctgaatgcgtttgttgacaatcacaatcatcgcgattaatccgatgacgcgggcgatagatgtggacatggccacaccggcaacgccgagaacaggaaagccgaacaaaccgaaaatcacaacaaagtttccggcaatgtttaaaatgttcatgccgatagtgacaaacattgtatcttttgtgtagccgtagctttttaagatcgcgctgaatgtcatgattaaagcctgaataaaggacagacctccgacaacttgtaaaaagactttcgcatcaggcatcagtgcgtctgataatcccatcatatgaagcagagggacagccgcgaaaaagacgacggcgctgatggccaggctgatgaagaagttggcgccgattgacacataagcgacttccatggcttctttcttttgccgtgagcctagaaattgtgaaatgataacggtcgttcctgttgcgataaagctgaacatcacgataattaaatttaaaatctggttgctgacgccgactgctgccacgctgttatccgagtattggctgagcatcagtgtatcggcattacccataaacatatataatgagacctcaataaagatcggccaagtaagcgaaaataatgagaacgttttgtcagcgggttttttcaaagcagttgatttgaagacagcttgtttcatagtgtctaacccctttcgtaaataaaatcaacgttttaaagtgtacctccatttccttataataaaaagggatagaaacgatacttcttgtaaaaatccgacttaaaaaggaggatgattcaaatgcctcgcatcctgtttacagtcccgccttttccggtatttatcgcagccggggaaggggtttttaaaaaaggagaaacccatgtgaaacgtgtattctccgtgtttgatctgatatatgtcaaacagggaacgttatatataacggaaaatgaaacatcgttttctgttgaaggcggcgagtacatcttgctttctcccggtcttgaacactacgggacgaagggcagtgatgaagcaacctcctactattggcttcacttcgatgaacatcgttatgaatttacgacaaagggaggcagcaactggtctgagcttcagcaggaaaaagggagcttcgaagagccggcccgctacggattggccttgccgagaaaaggcaaggtgcagcgcccgcagtttatggcgcagcagtttgaaaagctgatcgattactccgcggaaaactctgatttgccgctcagaaagcaaatcttatttgaggagctgatgctgcatcttcaaaaagaagcgttccaaataccgtctgcgaaagagcgggtagcctgggaggcggcccggtacttacaggagcactataaggaaaagacgacaatcaaggatctgtcgctcgcccttcactatcatcaggattatgtgagccgctgcatgcagcaggtgctcggcgtaactccggcacaatacacgaaccgggtgagaatgacggaagcgaagcgtcttttatcctctacaaatgataaaatgggcgttattgcggaaacggtcggaatggaagatccgacatacttttcaaaactctttaagcagatagaaggcatttcaccaattgaataccggaaaattgtcagccggaaagttcaataaccagacgagggatgaacatgaaaacaacaatttacgatgtggcaaaggcggcgggtgtctcgatcacaactgtgtcgcgtgtgataaacaatacggggagaatcagcgataaaacacggcagaaggtcatgaatgtcatgaatgaaatggcatacacgcccaatgtccacgccgcggcgttaacgggaaaacgaacgaatatgatcgctcttgtggcgcctgatatttcaaatccgttttacggcgaactggctaaaagcattgaggaaagagcggatgaactcggttttcaaatgttgatttgcagcaccgattacgatccgaaaaaagaaacaaagtatttttctgtgctgaagcagaaaaaggtggatggcattatttttgcaacagggattgaaagccatgacagtatgtctgctttggaggaaatcgccagtgaacaaattccgattgccatgatttctcaggataagccgcttcttccgatggatattgttgtgatagatgacgttcgtggcggatatggggctgccaagcatcttctgtcactcggccatacgaacatcgcctgcattatcggagacgggtcaacgacaggcgaaaaaaatagaatcaaaggcttccgtcaggcgatggaggaagcgggcgtgcccattgatgaatcacttatcatccagacgcgattttccttggaaagcggcaaggaagaagcgggaaaattgctcgacaggaacgctccgactgctatttttgccttcaacgacgtattggcttgtgccgccatacaagctgcgagaataagaggcataaaagtgccggatgatctttctatcattggttttgataatacgatactcgcagaaatggcggctccgcccctgacaaccgtagcccagccgataaaagagatggggaggagcgtcatcgaactgctggcagaagcaatagagggaaaacgaaaggcgaaacaaaaaatagtgctcccgcctgaacttgtagtcagacattctacatcaccgctcaacacatgagcccgctaatgagcgggttttttcattatgacagttgaagccaaaaaacatattgcgtgtaaaccaaaggcagtgtaaaatgaaaccatcttttgagaaagcgcttgcgcaaaatggtaaagcggatagaaccgctgtttttttagctgttaagagaaagcgctttctcgaagcgatcctgaaatgagataaaggagaggatgggacgtggaacatcaagtaagatgtgcagtattgggattaggaaggctcggttattatcatgcgaaaaatctcgtcaccagtgtgccggggcaaagctggttagtgtcggtgatccgttaaaagggagagcagagcaggttgccagagaattcggtatcgaaaaatggtcagaggacccgtatgaagtgttagaagatcccggcattgatgctgtcattatcgtaacgccgacaagcacacatggtgatatgatcatcaaagcagccgagaacggcaaacagatcttcgttgaaaaaccgctgacattaagccttgaggaatcaagagcagtttctgaaaaagtgaaagagacaggtgtcatctgccaagtcggctttatgagacgattcgatcccgcatacgcagatgccaaacggcggatcgacgctggagaaatcggcaaacctatctattataaaggctttacgcgcgaccaaggcgcgcctcccgcagaatttatcaaacacagcggtggaatttttatcgactgttccatccatgattatgatattgcccgttatttgctaggggcggaaatcacttctgtttcaggacacggcaggattctgaacaatccgtttatggagcagtatggcgatgtggatcaggcgctgacgtatattgaatttgactccggcgcagcgggggacgtcgaggcaagcagaacctctccatacggacatgacatccgggcggaggttatcgggacagagggcagtattttcatagggacattgagacatcaacatgtgaccatcctatcggctaaagggagcagttttgatatcattccagactttcaaactcgttttcatgaagcctactgcttggagcttcagcatttcgccgagtgtgtccggaatggaaaaacaccgattgtgactgatattgatgcgacgatcaatttagaagtgggtatcgccgcaaccaattcctttcgaagcggcaggccggtacagctagatgtgaagcgcgcttatacaggtatgtaaaagctaatatgttgcatttgaggctttccgcaaaaaaaagcaaggacattttagcccttgctttctcttttctcatataaatagtacatataatcagtaggtatgcctgaatggcccagctgtctcagcatggcggttacgttccctctatggtaagtcccgtgattgacgacatgcaggatggtgtctgcataggttgattccagtgtacctagtttcggatgctgcattgtgaaggtctgttctaagtccgtctggcggctgaagaaatcatgatactgtgactccagctcggcagcgtgctgtttaatcgctgccatattaccttgcgcggactctaatttgcctgcgctgtctataatctcttggtaggccactccagaaagaacattgagccaaatgtagtcagccctgcacatatgaagcagcacgtcgctgacagaaggaaatacgctctttacttcttgataggcagtttcctccggcaggttttcgatatgggtaaatattttcttgtttgcccaagaatgatagtcataaaactgttttgcatcagtcatcagtatgcctccttttctaagaaattcgtttttttcatttgtttctccttcaattgcaaaagagtgataccccaaaatatcctgccgctgcccacattaccgctgcagagcatttgtttacgatcagcataatcctgccgctcgtatctatcgtctgaaacaaccggcccgctattgcaaggctgataaaccaaatccaagacacagcgatgcaggcggccataaagagccatttctcaagccccgaatattgaagagagctcgtgccgatgacgccgatcgtgtccagaatggcatgcgggtttaaaagagaaacagcggccgcaaacgcaacttgcttttttggtgtgaacgtatgtttctcattttggcttgtgttcggacggctgttccaagtcacccagcccatatagagcaaaaataaaaatccgccggccatcatgactgtctcaaacacaggcagctcctgcacaatgacagatacgcccgcaacggctaatatgattaacagggtatcgcagactgaagcactgatgacagctgggagagcccgccaaatatgcttttgccacgcgccttgctgaaaaataaacacattctgcactcccagcggcaaaattaagccaaacgcgagcacaattccgtgaatgattgcattcatgctgaaaaagctcccttcacatttttttcaatcataagagagattgtcactaaagtctccagccatttggttgggttaggaaccagccaaatgtataatgtgtaaaaaagggggcatgaccttgtctcaatggcagccaagccgaaagtcggatgttccgctgcatcggcagatcgaacaatatatgaaagacaagattcttcacggagagtgggctgtagggacgaaaatcccctcacagagaacgctggccgacatgtttcaagtcaaccgcagcacagtcacagcagccatagatgaactcatgtctcaaggcttgttagagggaagaagaggcggcggtacgaaggttgtaaacagtacttggagcgtgctggcggctgagcctccgcttgattggagcgattacgtccgttcgggcattcatcgccccaattcttccatcatccaagctattaatcagaacgaaccaagagcggatatcatcagattaggaacaggagaactatcaccggatctgctgcctgctgacacaatgagccggatgtttcagcaaatcaatccgggcgccctgtctttaggatatgagcagccgaaaggaaatcgtcagctgcgggggcagtggccgaccatttaaaaggaaagaagatccatgtgtcaccgtctgcaattttaattgtgtccggtgcacttcaggcacttcagctcatctcaattggacttttaaaacgagattctgtcattttgacggagaagccgtcctaccttcaatccttgcatgtatttcaatcagcggggatgcggcttcgcggcttgccgatggatggtgaaggggtcaaagcggggcttgtttcttcttatcgaaaacaatatggaggacagctgctttacacgattccgtcgtttcataatccgacaggcacagtcatgtcagagcagcgaaggaaagagatcatcagcctgtcaagaaaagagcagctgcccatcattgaggatgatgcgtacggtgatttatggtttgaagaaaaatcgccgcagccgttgaaagcaatggatcatgagggcaatattctgtatctgggcacgttttcaaaaacggttagccccggtctgcgaatcggctggcttgccggtccggagccggttattgaaaggctggcggacattaaaatgcagacagactacggatcaagcggcctgtcccagtgggcggctgccgagtggctgtcacagggatattatgaagagcatctgacttgggtacgcaggaagcttaaagaaaggagagacgccgccgttcattttctcgagcggtatgccggggacattgccacgtggcggattcccgcaggcggcttttatatttgggtgacatttcacaaaaacctgcctgtcagccgtttcttttatggattgctgaaacggcaggtgcttgtgaatcccggctacatttatgacggtgaagaccgaaacagcatcaggctgtcatattcctatgcatctcttggagatttggaaactggcattaaagcggcagctgaaacagcacgccgcctgatgatgtcctaggctttggttatacgatgacagctcccagtgccctggcgaaggcaatcgcgtgctcaggtgcgattttgcagcctttcaatttgtcgagggagacatgaagctgttcaaaacggcacgtgctgatgtccatgttttgaagggacgtgccggtaaagctggcgccttccaattcgcacctgtcaaagtgtgtctgctggagcaccgtattgctgcattcactttgcataagagcacagtgatcaaatcgaacttgtttcatatttgagtacgaaaatgagctgaaatgtccgtggcattcctcgaatgaaacattccgcagcgttgcttccgccacattcattccaaccatttttgactgcttaactgaagttctgtgaatgacagccccgctgaaatcggcgtttgataaatcgcatttttcaaagatcacatcggtcagttcaatatgccgaaaagacacatcgataaagacgacatttctgaataccgttttttccacacagagtctttcgatatcttcgccgcagatggtacaatcttcaaacaaatgcatgctgattacatcatcctgcgtcacggcatcatgaaaatctgcggtttgcaggttttccggtatgttcggtttttgaattgcgattttattcatgtgatgacatcctttgctgcccgaaaaacagaggcttccgggttcaatttaatagatcgttaaggaaattgatacatatagtaaatcgtgaagagccttttcttggtacagcagcccgcttgttttgtaagcataaatggaaagcttcctatacgtcaaggcgtttacaggccgaaaaagccaaagggaacaggaggaatgcagaatggggcattacgtcaaaaccgaggagcatgtgacactgtttgtagaggatattggacatggaaggccgatcatctttttgcacgggtggccgttgaatcataagatgtttgaatatcaaatgaatgagcttccgaaaaggggatttcgttttatcggcgttgatttgcggggatatgggcaatctgaccgcccttgggaaggctacgattatgacacgatggccgatgatgtgaaagcagtcctttatacgctgcagcttgagaatgcgattcttgccggtttttcaatgggcggcgccattgcaatccgttatatggcaaggcatgaaggagccgatgttgataagctgattttactgtctgcagcggcccccgcgtttacaaaacgcccgggttatccgtatgggatgaggaagcaggatattgacgatatgattgaattgttcaaagctgatcggcccaaaacactggctgatttaggggaacagttttttgagaaaaaagtgtctccagagcttaggcagtggtttctcaatctgatgctggaggcttcctcctacgggacgatccactcgggcatcgcattaagagacgaagatctcagaaaggaacttgctgcaatcaaggtgccgacgctgatcctgcacgggagaaaggataaaattgcgccgtttgattttgcgaaagaattgaagcgcggtatcaaacagtcggaattggttccgtttgcaaacagcgggcacggagcattttatgaggaaaaagagaagatcaacagtttaattgcgcagttctccaactcataagaaaaaacccgacattgatcgggttttttatataattcctctgttttgcagtgcgttaatgatgagatcagctccatcggaaatagaggtctggtctgactcaatgatgaaatcgggtgaaagcggcgcttcatacggagaatcgatcccggtgaaatgtttgatctctccgtttcgcgcttttttataaagcccttttggatcgcgctgttcacaaacatgcagcgggcacttcacataaatttcgaagaactcacctttaggaaagagtgctctaaccatgtcccgatcctctctgaatggagaaataaaagccgttaaaatcatttgcccgctgtcgacaaacagcttcgccacttctccgatccggcggatgttttcaatcctgtcaccagtctgaaatccaaggtctttgtttaagccgtggcggatattatcaccgtcaagcacgtagctctgaatgcccttgcggtaaagcttttcatcgacagcattggccagcaccgattttccggagccggacaaacctgtaaaccaaaggacgcagcttttgtgtccgtttaaggactgtctgtcagactttgagatggcagcgggatgccaaatgatgttcggattgtgtgtcattgcaattccccgctgttttgcttgatggcaacaggctgttggtgaagtcccttgatcagcacggctgcgacctcagggcggctgaattctttaggcggctttttgccttggcggagaagctctctcacttttgtgcctgataagtggatgtggtctctcgggctgtgcggacatgttttggaggtgcccatgtttccgcattttcggcaataaaagctgtgctcaaaaaacagcggcttgatgcccagctcttcctctgtgaatgattgaaaaatattttgggcgtcgtatgttccatagtagctgccgacacccgcgtgatcacggcctacaataaaatgggtgcaaccgtaattttttcggacgagcgcatggaaaatcgcttcccgcggacctgcataacgcatggcggcagggaaaaccgataacatgacacgatcctttggataatagtgattaagcaaagcctggtagctctccattctgatatcgcttgggatatcgtctgactttgtttctccgacaagcgggtgaagcagcagaccgtcgaccgtttctaacgctgttttttgaatgtattcatgcgctctgtgaacagggttcctggtttgaaagccgacaatcgttttccagccgagcttttgaaaggccgctcttgtttctgcgggcgttgcataaaactgttcgaaagatttgtcaggcaggcggctgaccgtgataggccctccgatatagtaatccgggcgcgccagcaatttttttacgcctgggtgggcaggatcgtttgttttaaaaacagacagtgcttcttgtgttttatcaggctggtatatatcggtgactgtgatcatgccgtaggtaacaccgtctttcacaagcttgacgtgatctccggcagacagctgtcttgctgttttttctccgacaggcagcgtaatcggcaggctccacggcaagccgtttgccagcctcatttccttcacaacacgatgataatctttttctcccaaaaaacctgttaacgggctgtagccgccgatcgcaataagctccaggtcgctcagtgcaagctgatccagctcagcttggcacgcgcacccttcaaaacggcatgcgtgatcacagcggttgattaatacccctccgtggggttcgtttccattcaacgtgttcaacctccatttatacgtttccttgttttctttgctgcagttaatgaaagtttgacatcagcgcctcaacatcatttcgactctcatagccagaacctgccgtccgctattcttgatgcaggccgcattctgttttctcccgtccggcccatcttccagccctctcatcgttcgggtccggggaaggcaatgtacacatttcacagcctatgctcgggtaatgttgatcgtgcagtttgttataaggcaaattgtgcaggcggatgtacgtccaaacgtcatcccatgtccagtggatgagcgggcaaattttgatgagcgcaaacttctggtccaggtttacgtattgaatatgctttctcgttggcgactgctcccggcgcagtcctgaaatccaagctgtcatgccggacaggtgctttttgagcggttcgattttccgcaattggcagcagaggttcgggttatgcttccacagctctcctccgtacttcgtcccctgttctgttaagctcagctcgggttcgagcatctgaattgcaaatcccggatatcgctctttgacggtctcgatcagctcatatgtttcctgaaaatgaagcccggtatccaaaaagatgatgtgtgcatttttgttgatttttgatattaagtcgagaagcaccattccttctgcgccaaagctgcaggcgtacacaatcttttctccgtacgttcggtaagcccatttcaacacatcgagctcatcgatcaattgatccgttatctgtttggacagcatgtcgttccatgtgtcatatgtgatggtttcgttcaatgttttccccccgtttgcatctgctttttttatctattgatcgagttataggcagactattcattttttgcataaaggttcagggtttttaggggctgcgcccgcctaaaatgaggtgcggaaccattaagagcccggctgaatatgctttttagcaaaatggttttatgcccaaggagaggtagtatgccgattgccatttatcaggggcatcatcattcgcttgccccggctgatattaacatcgtcattgatgtcatcagagcctttacggtcgcccattatgcgtttatcggcggggcgaaagagattttgttggtccggacagctgatgaagcctttgcgctgaaagacgtctatccggattatgtattgacgggagaggaaaagggggtcggtatcagcggatttgatttagataattctccaaagcgcatggctgtgcagaatatggcggataaaagcctgatccagaaaacaacaaacggcgtcacagcagcattgggggcgctgaacgcaaagcatctgttcgtaactggatttaccaatgccaaaacaacggcacagcatgtgaaaaagctcgccgcaaacgattgtgtcataaacattgtggcttcccatccatccggtgatgacgatatggcgtgtgcggagtatatcaaaggcatcattgaagggacaaatgcggtaacggctgcggaggcgattgaaagaataaaacgctcttctgttgcggagaagttttttgacagccgccagccattgtttgatccggaagacatcgtttactgtacaaaagaactgacgggcgatttcgtgatgaaagtgaaacaagatggagaagttccaacgatagagagggtcataatatgaatgatttttcactagaattgccagtgagaacaaacaagccgagagaaaccggacagtccattttaattgataacggctatcccttgcaatttttcaaagatgtcatagccggagcgtccgactatattgattttgtgaaattcggctggggcacctcattacttacgaaagatcttgaagaaaaaatcagcacactgaaagaacatgacattacatttttctttggcggcacactgttcgaaaagtacgtaagccagaaaaaagtgaatgaatttcatcggtactgcacctatttcggctgtgaatatattgagatttcaaacggtacgctcccgatgacaaataaagagaaagcggcttacattgctgatttttctgatgaatttcttgtgctcagtgaggtgggcagcaaggatgcggaattagcaagccggcaaagctctgaggaatggcttgaatatatcgttgaggatatggaagcgggcgcggaaaaagtgattacagaagccagagaaagcggaacgggagggatctgttccagcagcggcgatgtcaggtttcaaattgttgacgatatcatttcctcggatattgatatcaacaggctgatttttgaagcgcctaacaaaatgcttcagcaagggtttattcaaaaaatcgggccgaatgtgaatctggccaatattccatttcatgatgccatcgcgttggaaacgctgcgtttagggctaagatccgataccttttttctgtaaaacagcggctgcggggctctcgtcgtgaagagagcctctgcctattattttttatggcggtacataggcgtgagatagggaagtgaggtcagacggatgttgtagatgaagtcgatgactcttgtcgatatcacttggcatatcagggcttgaatgacaatgccccagtcaataatagacgcggtgaccataaaaatgatgcaattcatgatgagcaggatcgtaccaggattcccgccgcggtagatagaaatcatcagagcaagggctccgaatcctccgttcgaaattttatatttgtataaaagtccgatgccgagtcccaataacactgcgccgcttgccagatcaagccacagattagatgtgatatccggaaaaaccgcatcaaagatcaataccgagacagaggtgacggtgatagaagcgagggtgccggtgaatgttctcatctccagccattttaaagcggtaaaaagcattgatacattcacagcccacactgaaaatccgtgggggatttgaaacagataatgcaatagcaccgcaatacctgctgcaccgcctgtcggaatatcatgcggaaataaaaacaaggacatgccgagtccttgtagtacgccgcctacgacaatcataaacgtaagttttgctttcatcagcagttcagccattaagtcatttgctcctttatgaaaagacttgtccgctgttttcattttatgaggctgtccatgatttatgtctcaaaataaagaaatggcccagcttaatatgctgagccatcccacttgtagcgattgacgatctccttattgatctctgttccaatgccttttcctttcgggatatggaccattccttttgaaggctgcaggctgacgagatctgtaaaaggattctccatgacgtcccactcgatcggttcaatgtgatcgttcttcattttagaccatgggggcagacaggcttgtgcaaataaagcatagagccgtgagagcgatccgtcatatgcatgggcggatgctctgacgccaaaataacgcgcgagctggaggcagtcccgaaactcatcaattccgttgacatgcatgacatcgggctgaatgatatccaaacagcgctgtgaaagaagaggcacatattgcgccgggcctttcatattttctccgccggcaacaggaacagacaaacggcttcgaagcatagcgtaatcctgcggctgatcaaagggcaaaggctcctcaagccagccaatgttcgtccattcggagaaatagcgctcccatttaaaagccgcagcggcatcgtagctttggtttgcgtccagaatcatcgtaatggagctgcctgctgtatgctgcagcgcattgatgtgccggacatcctccttgaatgaagtcccgccaattttgactttgatttgctcaaaaccttttttcaactgggcttcaacattggagactgagcggctgatccattgcggggagtctgagtacgattgaaaagacgcgtacacaggaatctcctctctgtatcgcccgccccataattcgcaaaccgaacaatccgcagctttggctgcaatctctgtcagcgccatgcttacagcggaggccgcccgctggtgccatttttgaatcgtgcgcactaatgacaggcggctgccagcctgttttcctaatagaaacgggatgatccgcttcgtaaaaccgacatggagagcagggagccaatcaacgcattctccccagccgtctatcccgctttcggtgataatcctgatgagataacaagtccgatatcgtttaaacccattggcatctccatatggcttttctaatcggtgaaatagcggaaaggtttcaatccgtacaattttcacactgggtgctacctttcctcagcgggctgtagccgatttccagccattttagtgtcttctttttcttttgtttcttcattgttttgcttcacatggatgagcatcatcacaagaatcccgacaacgagagtcaatcccgcgatgcttaaaaacatgccgggtctggaccattgcatcaggcggccgaaaatcggaggaccgatcgctacccctaagaaacgtacagagccgtacagcgaggtgacaaatccccgtctttccttgccgacagccccggtaataaaactgttcacacaaggaaggacaagacctgagcctatgctgctcagtacaagaacactgataaaaaggacaagattttcaatgaatgacagtgccgcgtaggatacggtcatgaacgccaatccaagtacgatcagctttttcattaacgattgcttttgcccgattttgcttcctgttgtataggacgtcacacacataaccaaaagcgggatcgctaaaatcaagccttttttcacgccgtcggtgtcgtatgttttttcaagaacatctgagagataaaacaggatgccgaataaagtaaacaaacaggtcgcaccggctaaataagcggtaaacagccatctgccttcatgtttaaagacacttaacagcccttttgcatattttccgattggtggcggttctttttcctttttcttttctttaataaaaatccaagtcagtacgatcgaaatgatacaaaacacaggaaaggcaaaaaacgcgccataccagacaagcagggcgatcagcgagccaatgatcggcgatagcactttccccatgccgtttgaagcttcaacaaggccgagcaccttgctctcctgggcgcctttaaacagatctcccgtcagtgccatggcaattgggccggttccggctgccccgattccctgtaacgctcgtcctgccatgacccaaggataggcattgtcaaaaaaacctgccgcaaacccggctaacaaaccgccggcaccatacaaaattaagcagggaataatgatgactttccttgagaatcggtctgcgagataaccgacaatcggaatcgcaaatgctgcaatcaaggaaaatactgtgatcacgagactgacttgaaattgtgataaatgaagttcagatttcatttttggcaaaatcggaataagcatcgagtttcctagggttaatattaaagggattgaaccgattgctacaatcgtcattccattattttgttttgatgattccatctcagagcacactccttttcttctgcttagaatgtccctgatggcttcgtttattcagcgatcagacagcaaaaaaccgaacagaagatacctgttcgggaaaaaagagggttaaccgagagcctgtgaaatcaaagcatataagtgtccattttgaataggcgcttttttctgatagaacaaaagcggaggttcatcatctttatgaaatcccatttctatcaggctgtcatgcagagacgtgtgttcactcggtatatcgattcgcatcggcccttgtttgccggccgccagcctgttaattatttgtgctgcaacatctgatgatggagcgatgatggggccgaatttcaaattggccggtgtctgtacagaaagtccgtagccaattagctgtccgtcctgatttcgggcgatgatacattcgcatgaagcagaaataagctgctgcaaaaggtttgatcgatctccgccaaaggcagccagatccgccgcggttaagtcgtgaaagtcttgttctctaaaggatgtcagttcagcatcaagcttttttgtataaggttgaaaactgtgacagctgtactttcgcactgaaccagccgtatgaaaacctgctttttcataaagcggcaaaccttcttttgtggcgcaaagcctgatggcggtgttttcatccgtttgggtgatacaggcgtttaccatacgccggccgagaccgagccgttgatattccttgtcaacgataacgaggccgatagaagcaagactgccaaacaaaaacaagccgatgcaggaaataatatcaccgctgacattttgatagccgaaaaagcgtccttgctggacaagcagtgccagctcttgttcgccgtaatccggccacccggcttgcctgcaaagccgcaataagccggaaacatgttcttcatgaagctcaatcagctcatccactacatccataagatcacctgcttgttcctagtgttttgtacatgacaatatgagtgcctatgccgggaatctcaaacggttcgccgagttcttcccacccaagttttgaatagtagcctttcacatggcttctggcattgcaccagaccgcctgaacgccgttctccgccagtttctcttccgcgtgtttgatcagcgtgctcccgcctttttgatcgcgatatccttcaagcgttgccatgcctctcagccgatatgctggggattctgttattaatggctgaatttgcggggaaaaagaggcgatgctgatcagctttccttcaaaaaacgcgccgagatgaaaggagccttttgcatgatcctcttcatatttgcattgttcaatggattgatggggacgcagaatacggtgccggatttcatatgtatcttccgcggaaatggttttgacttcgagcataatgttcctcctcatgactgtttttctatatcgtaacacgaatcccgttgaaaaagaccgcccgattggatcagacagtcttttaagggattaatgcaaaaagatattttggcgctgctcatctttttgctgaatatatgaagtaagctcagcggttaagtcagatctgaggaaaggcgttatcaagtagatgccgttaaacagctcgcatgccgtatccagcagggagcgtgcaatcgcaaggccttccgccttttgtttttctttatcttcaccggcacgggccattttttcgcgaatcgtatcagacagcttaatgccgggaatttcattatggatgaattcggcattccggctgcttgtcagcggcatgatgccgatatagaccggcgtcttcagatgttttgtttcgttatggatatcgacaagctgctgctcggaatagacaggctgagaaacaaaataatctgcgccgcaatctatttttttctcaagccgttttaccgctttatccagatggcggacgttaggattaaatgcggcggcaactgagaaattcgttttcttgccgagcggttttccagatagagacagaccttcattgaattgtttgatcagcctgattaaatcaaaagatgttaaatcatatacagacgtcgcaccaggaaaatccccgattttagaagggtcacctgtaatcgcaagcacgtcattcagccctaacgtatcaaggcccattaaatgtgactgtaagccgataatgttacggtcacggcaagtaatatggacaagggaacgcatatcgagctgctgcttgacaagggcgccgcaggcaacattgctgatccgcggggtcgccagagaattgtcggcgagtgtcagggcatcgattcccgcttcttttaattcagcagccgccgatagaaatttgtcaaagcttagttttttcggcgggtccagttctacgataatagagcgttttttcgccgcgatctcatccaggccgggctcggttcgctcgtgatgaacagaaatgaattcttttgcccgggttttgacttctttttccgtaatcggagccagcccgccaaccgcttccgccatcgccctgatgtgattcggtgttgtgccgcagcagccgccgataatccgcgcgccttgcttacggaattctgacgcgctgttttgaaaatacgtgtcgtctgtttcatagacgagccgtccctcttcaagcgaaggaagactgctgttcggataaacggataagaatacgtcatcaaaaatcggcacttcgctgagcgcttcaatcatgtgataagggccgaggcggcagttaatgccgacaatatcagctccgagatccgcaatcgagcgcaatgcgtcagaaagcggtgttccgtcctgcaatacgccttgctcgtgcatggagacattgagcataatcggaagatcagtctctttgcgcgcgattttcagcacttcacgggcttcttccaaatcataatacgtttctaacagcaagccatccggctcttcatgcagcagcaggtacagctgctcgcggaagctgcgcttaatttcgtcaagactgtacgcgtttttattaaatgtgcgtatgccgcccatcgttccaagcacgtatgcatcgcctgctgaagcccgtgcgatctttacggcctcctgattcatttttttgatgtcatcctcaagcccgtgtctggataatttaatatagttggccccgtacgtattcgtttgaataatgttggctcccgcttcaacgtacgctttatgtatgcgctgaatttcctccggctttgaaatattgagctcctcaaaacacctgtcaatgccataggagtagaggagcgtccccatggcgccgtcaccgattaacacctgtctttgcaaatcttctaaaagtcccattgtctgcctcctttattcacatcagcaaggaaaaaagagaaataaaaaaagtcctcttaagaagaagactttgtcagtgattttgtctcttcttatcttccaagctgttcgagcttgctggatttagcaccttggtcatggctgatcgccattacaccggttgctgaagcttcgtcgggccagtccctctgcttctcttgataagaacggatatgaaattttcgtgtcagaaagtgccaaaagatacctggcgtttttccctttctccaaatttaccgaaaataaagacaataatcaataggaatcagaaaatttatctgaaatttataaattgaacgtcaactggcaaatctgctccccgcacagctgagataatctgctgcaggtcatctttgttttttccggtgacacgcacttgatcatcctgcacctgagactttactttcagtccggagtttttgatgattgtattgattttttttgcgttgtccttgtcgatgccttgaacaagctttgcacgctggcgtaccgttccgcctgacgcgttttcaaccttgccgtaatcaatgttttttgtcggaacgtttcgtttaatcaatttgctgaccagcacatctttcagctggcttaatttgaattcgtcatcggaaacgaggaccagctcctctttatctaaagaaatgtcgcttttgctgcctttaaagtcatatcgggtactgatttccttcagtgcgatttggattgcgttttgcacttcaggcaattccaccttggatacaatatcaaatgaactttcttttgccatatgaaaacctccataacatttaacttatgtgttgattatagtagaataaagagaaacttccaacagaacaaagaatcaatttgtgatgattggaaaaaatgttaacaaaatccgcagagattaagcggaacaggaaggacgatagcatgagaccagggcagcaattaaccttgagtatagatcaccaaaccgacttcggttactttttaaccgatggggaagatacgattctcttacataacagtgaaatgactgaggatatcgaggacagagacgaagtagaagtctttatatacgtcgaccagcaggaaaggcttgcggccacgatgaaaattccggtcatcagcgcggatgaatatggctgggttgaagtggtggataaagtggaagatatgggcgttttcgttgatgtcggtttatcgaaggacgcactagtcgcaactgagcatttgccgccgtacgaagatgtctggccgcaaaaaggggacaaactttactgtatgctgaaggtgacgaaccgggggcgcatgtttgcgaaaccagcgccggaagatatcatcagcgaactgtttaccgacgcttcagaagatctgatgaataaagagctgacaggtacggtgtacaggctaatcgcatcgggttcattcgtgatcacggatgacggtatccgctgttttattcacccgtcagaaagaaaagaggagccaagactgggttcaagagtcacaggccgggtgattcaagtgaaagaagacggttcagtcaacttgtcgctgcttccgagaaaacaggatgcaatgtctgttgatgctgagtgcattctaacgtatatgagaacgagaaacggtgccatgccgtacagtgacaaaagccagcctgacgatatcagagaacgttttaatatgagcaaagccgcctttaaacgcgcactgggccatttgatgaaaaacggaaaagtgtatcaggaaaatggatggacatacgagaaaaaatagcatgaaaacggctcgcctgcagcagactgcggagcgagccgtttttttatgtctagtttaattcatcaaccagcgttctgattgccatttcgcgatccacattgtctgaaatcgcaatcggcgtaatatcaatggcgagaatgatcagaatcagggcacctgctgcagcaacataagaaacataatagaaatagttagcggtatcaacagtgttgacaagctcggcctgaactctggatgtatcatccttggaagcggcgatttcctttgctgcttctactttttcttcaacgatttgacctgcttttttcagcagttcatccactttcaatgcatctttgctgtaaacagctttcttcaggttatcaaaaaagtcagcatcctcttttttaatatcagcgacaacctgattggcaaaagcctttgcctgttttgtgttgagtttgtctgtcatcgctttattaaagacctctggaagctgtttgccaacttccccttgggcaaacacaaagcctttaaaaatttcctcacctgaatactcaagctgctttgcctgtgccacactttcttgctgcttcaccaaaaacacagtcgtcaccaatacaaccgacaaaaatactagaaacgccttcttcaaactgaaacctctcccttcttgtgttttttattccacaacagtctgcgaatatatgtaaattgaatcgtggaatcgataggagtgagatacaatatcaaaatgccggccatgataatggaaaaactgataaggcctagcatgattgcaaaaatctcatgcataaaaacagcgatgatcaaaatcaatctccaatgcttcttcggcgcaaacaacgccgcgaagatgacaatttgaaccagcagcgtcccccatgtcggaatcaccacgaacggacttgttaccattggcttcgttaacgcctgaaaaaagccgttgaagccaatggttttttcctgggcgaaataatagacggccgttccgtccacccattcctgctgagacagcttagcgacggtagagtgaaaataaagcaccgccacttggattctgatcacagaataagaaataaaagctgttatttttccaagtgttcttttgccctctataggtctcgtgctccaatgccattttctcggatcggtcagcgtgatgggaagcaataaaaaggtcatgacggctgctgcctgctcgcctccgtcgatgacgatcagcgatgactgcaggctgtaactgacataccaatgcagaaccccggtgattctggggcgccagccaatgacaacaagcaccagaatggcaatgcagacccatctgaaaagatttaacatcatatagttattttcgccgaggcaaaagagactgagattcattttacaagctggatagctgctgatcccgctggctggcttcataatgaggctcgggtgattgatgagcagcgtcagcaggctggatagcgcaatgatgcttcgcgcgaggccgtatacatttgtccacgggtttctttcgtcccatctggtgatggtctgttttatgttttcgagcatgagatcacaaccttgactatgctttttacctgataagacgaaggggtgtatttagaatagctccaaggaacaatatcctctttcgtcaaatagtagctgccacaaagcagcgggcggggagcgggtgtttttaattgcacggttttggctttgcttttgcatgcgccgaggtccttttctttacatgctgtccactgttccttgccgacttggctgtagatcacgcccatttcaacgccttgtgaccgcccataccgatacaggccgaataggttgtcagccctcatattgggccatctgaccttggcgctggcattttcagcctcatataagccgattgcagtatcacgcggatttttgctgaaaaagccccagccctgagggaggatgctggacatgagaaatttggagtcctttgtcagcggaatcggggttgtccccaagctgccaataatagaaaacagaaatagcgaaccccaaaggattgaaaaaatgacaaaaaatgatatcgatttctgcattcgactgctccttttaacctgaagaatcgtttttacacttttcataatataaaaacatttatgtgataaaaaggttaaaaagtatgagaaattccatttttgttaaaagaaaaaacaggacattttacactgctatatgtgattgatatatagtgtttttttcgatatatttaaaccatgaaaacgaatcaagttaatgaccgctggattgttcaatttcgaaaagggattttcgagctggccatcctatccctactgcgttctaaaccgatgtacggttatgagctgacgtcatccttaaaaaccacctcggcgctggctatttcagagggagcgatttatccgattctgaaacgtatgaccgagaagggatggatcgaatttttttgggaagattcactggacggcccgaaaagaaagtattacaaaatgacgcaaaaaggagaagaaatgttaaaagaacggctggagaaatacctggaaacccatcaagccttactgtctttatcgggggatttgctatgaatggacagcttatcattgaccgatacatggaggaactaaatgcagagctggcgaatatgcctgatgtagagagagaaaacgctatcgacgaattaaaggggcatatcaccgctttcgttcaagacagaatcaaagccggccttagtgaagaggaactgcaggaagctgttgaatctgaattttctcatccgaaggagcttgccgaattgatgatgggtgatgggggagagacgaaaaggaggaggtctttattgggcaaaagctggatttcggtccttctcattgtcacgattatcgccctgccgctgctgccgtccgacttcagacatctgccgctggctgtttatttaatggtgctcgccggatatgtatggaagcggaaaaaattgatgatgtttgcaggtgtcagaaaaaacaaaatgcgctctcaaaaggagattgtcaagatttcgcgagtcggtgcggtttatctgctgtttttagcagtgctgcttcttttgagcccgttcctcaatgcgcttgtcgtcctgctgctaattgcagtaagctgcgccgctttttttctttttcttaacatcaagtaatcttgtaggaggctgtaagatggaaatcagcatcaattatctattaattgtcatcgcgcttttattctttgtggttgcctattttgtcggaatcaaaaaacaaacctggatgctggctgggtttaacgaggcgcgtatacgggataaagaccggctggccagaatagcaggctactttttcttgaattccggtttgttcattttgctgaatagttttatctcatttcaaggtcaggagcagctcatacctccgcttatactggcatatggagcaggggttattatttatgtcaataaaaaattagtagagtaggaaaagaagggcagagcgaaatatctctgcccttcttttttgggaaaataagaacgaagcaccacatacaagtttttgtatttttgataggatgaagaaaaatggtagattccaaaataggaaggatgtggtgttttgcgcaacctgaccaagacatctctattactggccggcttatgcacggcggcccaaatggtttttgtaacacatgcctcagctgatcaaagcatcaaatacgaccatacgtatcaaaccccttcatacatcatcgaaaagtcaccgcagaagccgatacaaaacacaacccagaaagaatcgctattttcctatcttgacaagcatcaaacgcagtttaagctcaaagggaatgcgaacagccattttcgcgtttcgaaaaccataaaggatccaaagacaaaacaaacgttttttaaattaacggaggtttacaaaggaattccgatttacggctttgaacaagcggtcgcgataaaggaaaacaaacaagtgaaaagtttctttggaaaggtgcatccgcaaatcaaggacgtctccatcacaccgtctatttctgagaaaaaagcaatacatgcagcaaggcgtgagctcgaggcttccattggaaaaatcgaatatcttgatggggaaccaaaaggcgaattatatatctatccacacgacggtgaatatgatctcgcctaccttgtcagactctcgacatctgaacctgagcctggctattggcattatttcatcgatgccaaaaacggaaaggtcattgagtcctttaatgccattcatgaagcggcaggtacaggaatcggcgtgtcaggtgatgaaaaaagctttgacgtcacagaacaaaatgggcgcttttatttggctgacgaaacaaggggaaaagggatcaatacgtttgacgcgaagaacctgaacgaaaccttgtttacgcttttgtctcaactgatcgggtatacgggcaaagaaatagtcagcggcacgtccgtatttaatgaacctgcggctgtagacgcacacgcaaatgcgcaagccgtttacgattattacagcaagacatttggccgtgattcttttgatcaaaacggagcaaggattacgtctaccgtgcatgtcggcaaacaatggaacaatgctgcgtggaacggtgtccagatggtatacggggatggagacggttcgaaatttaatccgctgtctggatcgctcgacattgtcgcgcatgaaatcacacacgcagtcacacagtattccgccggtcttttatatcaaggagaacccggtgcattaaatgagtccatttctgacattatgggcgcgatggctgaccgtgatgattgggagatcggcgaagatgtctatactccggatattgcaggagattcattgcggtcattggaggacccatctaagcagggaaatccagatcattactcgaaccgctacacaggaacagaggattatggcggagtccatatcaattcgtccattcacaataaaacagcttatcttcttgcagaaggaggcgtgcaccacgatgtacaggttgaagggattgggcgtgaagcaagtgaacaaatttactatcgggctttaacatattatgtaacggcatctacagatttcagcatgatgaagcaagcggcgattgaagctgccaatgatttatacggtgaaggctcgaagcaatcagcttcagtcgaaaaggcgtatgaggctgtcggcattctatgagcaagcaaaaacagtcaggacacagagtctgactgtttttgtttgctcattttcttaaaaagaatatcgccaatgtacctgggccagcatgcgagccgattgctgaactgattggatgcataatgatttctttcggcttgaacgcttcctcaatcaggtgtttcatgtccgtggctttttctttgttcgcggcgtagctgatcccgacggtttgattgctccaatcatccccgcgctctttcataagctcgatgatccgtttgaaaagtttcttctgtccgcgaattttttccagaggcacaagcttgccgtcctccatctgaagcagcggtttaatattcaacaggccgccgacaaaagcggacgttttggatatccggccgcccctcgcgagatatgttaaatcatcaacggtaaaaatgtgttcaagctggctgcaaaagttctttacagacgtttcaatttcttgtattgtattcccgttgatacagagatcggcagcatgccggacagccagaccgtatcctaatgaagcgcatttggaatcaatgacccgcaaatcgaaatcggggaattcctccttcacttcattggcgatcattacagctgtctgatacgtgccggagagacctgaggaaaaggcaatgtaaagagcgggatcacctgtttcggcatattgcaaaaacacatttttaatcgtttgcggtgaggcttgggacgtcttaggcgtttctccattttgcatcgcttcaaatatttgatccgcttgaattgtgactgcatcttcgaattctttatcgccgagagaaaccctgagtggaataaagccaatgcctttttcttcaaaataagaacgaggcaaatcagtggcgctgtcagcgatgagatgaactgtcatattgcttcccttctttccgttatcgctcgttatcatgagagttaagccaactatatcatattaatttgccaaaatcgtgttcaaatatttgttttaagggaaaacataataaagaagaaagagcggaggaacatgccatggtactagatcaaacaaaaaaattactcatcgtcatcatcggcgctttactcaatgctgccgggctgaacttatttttgatacctgcagatgtatatgccagcggatttacaggtgttgcccagcttttatcaagcgtcgttgatcaatatgcccccttttacatatcgacgggaacgctcttgttcctcttaaacattccggtcggtattttaggatggctgaaggtcggcaaatcgtttacagtgtacagcattttaagtgtcgcactcactactctgtttatggggatcctgccggaaacaagcctgtcacatgacattttgctgaacgcggtgttcggcggcgtcatttcagcagtcggtatcggcttaacattaaaatacggagcttcgacaggcgggcttgatatcgtcgccatggtgcttgcaaagtggaaggataaacccgtcggcacgtatttcttcattctgaacgggattatcatcttgacggcaggattattgcaaggttgggagaaagcattatataccctggttacgctgtatgtgacaacaagggtgatcgacgccattcacactcgccacatgaagctcacggcaatgatcgtgacgaaaaaggcggacgaaatcaaggaagccatttacggaaaaatggtgcgcggcatcacaactgttccggcaaaaggagcttttacgaacgaacagaaagaaatgatgattatcgtcatcacgaggtatgaactgtacgatttagaaaagatcgtcaaagaagttgatccgaaagcatttacgaacattgttcaaacgacagggatttttggtttctttagaaaagactgacgaaagcaggtggaagtcgtgaaacggctgcttgtgatgctcctccccgtgctgcttttgataggctgcgggaaagatgagcagacagaacccgataaggaggtatcaggcggaatggagaatcaagaggttgttttatctattgacgcaattcaggagcctgaacaaatcaagtttaacatgtcgctgaagaaccaaagcgaacgtgctattgagtttcaattcagcacagggcaaaaatttgaacttgtcgtgtatgattctgagcacaaagaaagataccgttattcgaaagacaaaatgtttacgcaggcttttcaaaacctgacgcttgaatctggagaaacatatgatttctctgatgtgtggaaggaagtcccggagcccggaacctatgaggtaaaggtgacatttaagggcagggcggaaaatctcaagcaggttcaggctgttcagcagtttgaagtcaaataagaggctatggcgagtcgccatagcctttttttattggagtttgtccagctgattttgaaattgatgcagctgttgacgttccgcatctgtcgaattggcatacgcagaagatacagcatttttggctctcagaatcgcttgctcctgatcgccttcctcaaagccgtttgtcaccatgaccgcctgttgaacaaatgattttgcctgctgaaacagttcatttctcatttaatattcaacctggctttcggccgagtctcgtgccgcggcatgctggtgagcttcttctaaagtagaccgatatggaaatcttgcggcgtgtagcccgatggagtctttaccctgctgaataaaccttctggatttgcttcgtttacccattttgagactgcccccttccatactttgacgagatgagtcgtcttcaatagtatggtggggcaaagtaaggtttatgagtgggaaaaattaatacggaccttctttaaagtgagaaatattctttcaaaaaccttgcaacgccgtcctcttcatttgtagccgttgttcggttggcaatctgcttgaccgcgtcaattccatttcccattgcaacgccgcagcctgcaaattcaagcatttccaaatcgttatcctcatccccgaaagcaatgatccgctccctcggcacgccgtaataatcgctgattttctgaaggccgaccgctttattcatgccgcttttgataatttcaatgacatgccacggtgcagcccatcttctatggtcgattacctcggcatgcacatctgataaatatgagcgtattgccggcacatcctcttcttttgcatgtatgagtacagacgtcacatcttcaccaagattttcccgcaagtctccgaccgttacatttgttgtgttcatgttaaaggcatctatcaggtgctcatcatggtaatgaaagtatacgtcgtcaatcacttcagcaagcacgttatgtacgttgtagctctcgctgatatccacgagctgtttgacaacatcaagcggcagtgacgtatgataccgtccccatctgtcgtcttgcggatgatggacaaatgctccgttaaaattgacaattggcgttgtcaactccatctgctggtagtacatggaacttgaacgatacggacggcctgttgagatgcagacataatgcccgtcatcttttaggcgctgtatcgtatgaagggtgttttcagatatggttttatcatcctttaataatgttccatctaaatctaatgcgattaaatagggttttgtctccatgaaaagctcctttaaccttagattttgcttgttttgccttacttacagtgtagctttttaccatctttattgtctacatgttacacttatgattatggttatcctaaggaggggcacattgtgatacaaattgagaatcaaaccgtttccggtattccgtttttacatattgtaaaggaagagaacaggcaccgcgctgttcctctcgtgatctttatacatggttttacaagcgcgaaggaacacaaccttcatattgcttatctgcttgcggagaagggttttagagccgttctgccggaggctttgcaccatggggaacggggagaagaaatggctgtcgaagagctggcggggcatttttgggatatcgtccttaacgagattgaagagatcggcgtacttaaaaaccattttgaaaaagagggcctgatagacggcggccgcatcggtctcgcaggcacgtcaatgggcggcatcacaacgcttggcgctttgactgcatatgattggataaaagccggcgtcagcctgatgggaagccccaattacgtggagctgtttcagcagcagattgaccatattcaatctcagggcattgaaatcgatgtgccggaagagaaggtacaggtgctgatgaaacgtctcgaattgcgggatctcagccttcagccggagaaactgcaacagcgcccgcttttattttggcacggcgcaaaagataaggtcgtgccttacgcgccgacccggaaattttatgacacgatcaaatcccattacagcgagcagccggaacgcctgcaatttatcggagatgaaaacgctgaccataaagtcccgcgggcagctgtgttaaaaacgattgaatggtttgaaacgtacttataaagcacgaagttattaacaagggctgaatttacgttatactgtagaaaaaaggagtgagggaacgtggaagaagcattaaaagaaaacatcatgggcgccctagaacaggttgtcgatcctgagcttggcgttgatatcgtgaaccttggtttggtatacgatgttgacatggatgaagacggcttaacgcacgtgacgatgacactgacatcaatgggatgccctttagcgccgattatcgtggatgaggtgaaaaaagcattagcggaccttcctgaagtgaaagacacagaggttcacattgtatggaatccgccttggactagggataaaatgtccagatacgcaaaaattgcgcttggcattcaataaaacaaaagaggacagcctgacatgtgaggctgtccttttttacagctgaaaggagtgaaaggaaatgatgtacctgctggcagttttatgcccgccgcttgctgttttgttttcgggaaaaccgtttcaggccttgctgaatctcatattgacctgtatcttttggctgccgggcgcgattcacgcctgctttatcgtcgccgaccgccgtgccgaaaaacgggcaagaagataatttggaaaaatgaggacgcagtcatggtataatggtcataaaaacagcagggagagcactatgaaaaagaaattgcttgcattcgcgctttgtactggcgcgtatgcggccctgtttgcgtactctgtgaactcagagcaaaaaacagccacaagcgagatgacggatgtcagccgcctgatgcctgtaaaaataaagcagacagtgaaagggcaggaagaggaaacgctcattgacacagtcaaagaggcaaatcgaaaaaacataaaaatttcaatcgccggggcccagcactccatgggcggccatacatattatgaggacggcatcgttctcgacatgacgggctacaacaaaatcctgtcactcgatcaagagaagaaaaccatcagggtgcaaagcggtgcaacgtggaatgatatccagaaatacgtgaatccatacggactcgcggtaaaagtcatgcagtcacaaaacatttttacaatcggcggatctctcagcgcaaatgcacacgggcgtgatattcgctacggctcgctgattgatacagtcaaatcattccggcttttaaaagctgacgggacgattatcactgtcactccaaaagatgatttgtttacggcggtcatcggagggtacggcctttttggcgtgattcttgatgtaacgcttgagctgacagatgatgagctgtatgtcatgaagacagaaaaaatgaattacagcacatacgcagactatttttcaaagcatgtaaaaggaaatccagatgtccgaatgcacctggcgcgaatttcaacagcgaaaaaaggatttctgaaagacatgtatgtcacaaattacgtattggctgatcatcaggatcaactgccatcatacagcgatctcaaagaagatgagtatacgggagccacaaagtttgcactcggtttgtcaagacggtatgaatggggcaggaattggctgtgggacacacagcaatcctatttcctgagccaaaacggcacagagatttcacgcaataacgtcatgcggtccgaatcaaagtttcttgagtatgaaaacaatgacaacacagatgttttgcaagaatactttgtgcccgtgaaggagtatgggtcctatattgatgacctgagacaaacgctgtcggacgaagatctgaacttgctgaacattacgatccgctacgtgcagaaaaatgaaaaggccgacctttcctatgcgaaggacgatatgttttcgctcgtgctattaataaacgagggcttttcaaaagaagaccaggcagatactgcccgaatcatcaggcgcatgacagacgttgccatcaagcacggcggcagctattatctgccttatatgacctaccagacaaaagagcaaatgagacaggcatatccgaaaagtgaagcgttttttcagaaaaaacgaacctatgacccggatgagcgctttatgaattacttttatcagaggtataaataatggggaaaaacaaattaaaatggctgacattatcacaaagcagcgtgtttttcgcaagcagcttaatctttccgttttatattctgtttgtgaaaaatatcggctcaagctacacacagttcggtttttcctacggattgttcgggttgagcggagcgctcatttacccgctcctcggacggctgtctgaaaggtttgacagccgttattttctgcttctgaactcgtgggggatggctgttctgcttttatatgtcccgcatatcggaagcgtcgttcaagtgtacatcgtccaagtgctgttagggctctttggagcgatgcaaaagcatggagaaaaagtgctgatcgctaattttacagacagcggagagcgtggaaagaagattggaaattaccatttttggacagctgtcttttcagcagcagccattatgctcggggctttctcgctgacttttttacagtgcaaatgattttttatgcaagctctattctatattttttgagtggattgatgatgatgaaaacaggctgacgcggtcagcctgtttttttatgcggctgaaatgcggcgccgcatcaacgtttttgtgctgaagtcatgctgatttttttgagcggaatttccattgaacagaaaatttataaatgaataaaaatattaaatatacgattgaattaatttttattcatgttataatgttaaataatttcacaaagaccaagagggtgaacttgttttgaaaataggaattgtaggtgctacaggatatggaggcaccgaacttgtcaggattctttcgcaacatcctcatgcagaggaatgcatactttattcatccagcggagaagggaatgtctatagcgagggttatcctcatcttaccggcttagcggatcagcagctgaagccgattgatatgaatacgatcaaacacgaaatagatatcatgtttctcgctgcgccgcccggagtatcaagtgaattgactccaaagctggcagacgcgggaattccggttattgatctgtcaggtgatctgaggatacaagaaccggctgaatatgaaaaatggtataaacggacagcggcaccgaaggcggtgattcaagaggcggtatacggtctggcagaactgaatcaacagcaaattcaacaggcgaaactcattgccaatccaggctgttttccaacagctgttttgcttggcctcgcgccattggctcaaaagaaactgctcgatgaatctttcgttatcgttgacgcgaagacgggtgtttccggagcgggaagaaaagcatccatgggaacccatttttctgagctgaacgacaattttaaaatttacaaagtcaatgaacatcagcacacgccggaaattgagcaggcgctgaatgaatggcagccaggtctcgggcccattacattttcggctcacttggttccgatgacaaggggcatcatggcgacgatgtataccagattaacctgtgatctatccgcagatggcctgcatgatttatattcggaattttaccaagattcatattttgtgagagtgaggccaaaaggtcagtacccgcaaacgaaagaagtgtacggcagcaatttctgtgatatcgccgtgaccctcgatgagagaacgaacagagtcacgatcgtctcggtaatcgataatttaatgaagggtgccgccggtcaggcagtgcaaaactttaatttgatgaatggctggaatgaagaaactggactcaccatcacgccaatttatccatagaacgggagagaatcgaaccatgattcagttaagtgaagatcaaattgtaaaagtaacaggtgatgtatcctcgccaaaagggtttcaggcaaagggtgtgcattgcgggctgcgctactcgaaaaaagacctcggcgtcattatcagcgagacaccggctgtgagtgcagcagtttatacccaaagccactttcaggctgctccgatcaaagtgacacaagacagcttaaagcacggaccgacactgaaagccgtcatcgtcaacagcgccattgccaacgcctgcacgggagaacagggcctaaaggacgcatacacaatgcgggagagctttgcttcacagcttggcattgagccggagcttgtcgctgtttcatcaacgggtgtcatcggcgagcatttagacatggaaaaaatccacgcggggatcgagctgctgaaagaaacacctgcgggatcaggcgattttgaggaagcgatcttaacaacagatacggtgattaagcagacgtgctatgagctggcaatcggcggcaaaacagtcacgatcggcggagcggccaaaggctcagggatgatacatccgaacatggccacgatgctgggatttgtgacaactgacgcggcaattgaagaaaaagcgctgcaaaaggcgcttcgggaaatcactgacgtttcatttaaccaaatcacagttgacggagaaacatccacgaacgatatggtattagttatggcgaatggctgcgccgaaaacgagtgcctgacagaagaccatccagactggccggtctttaaaaaagcgctcttgctcacttgtgaggatctggctaaagagattgccagagacggagaaggcgcgacaaaactaattgaagcccaagtgcagggagcgaaaaacaatcttgatgcaaacgtcattgccaaaaagattgtcggctcaaatcttgtaaaaacggcagtatacggaacagatgccaactgggggcggatcatcggagccattggacactccgcagcacaggtgacggcagaagaagtagaggtttatcttggcggccaatgcctgtttaagaataacgaacctcagccattctctgaatctatcgccaaggaataccttgaagaagatgaaatcaccattgtcatcaagatggatgaaggggacggaaacgggagagcgtggggctgtgacctgacctatgactatatcaaaattaacgcgagctatcgcacgtaataaaggggagcgaaatgaagaaaacaatcgtttttaaatgcgggggaagtgtcatccgtgagctgtcggaggaattttttcaaaatctgaaagagctgatggcatcaggctggaagctggcgatcgtacatggcgggggaccggaaatcacaaatatgctgaaacggttaaatatcaagacagagttttcgggcggacagaggaaaacaacgaagccggtgctggaagtggcggaaatggttttatccggttctgtcaataaatttttcgttgctgagcttgccaaacacggactgcgagccgcaggcatttctggtaaggatggaggtcttttggaggctgattatctagatccggaaacatacggagaagtgggagaaatcaaaaaagtcgatgcgtccatggtgaacgcgctgatggaaaatggcatcatccccgttattgcgccgctgtctatgacaagcgactgcaaaacgctgaatgtaaatgctgatctggctgcttcagcagtcgccggagcgcttgaagccgataagctgatgttcgtcacggatgtcgatggaatcatgaaggaaaagcaacgtctggacgtcctgacccctaaggagattcagatgctgatcaagcaggaagtgatcaccggagggatgatcccgaaggtcaattcagccttgtcagctttatcagatcaggtgtctgaagtcatgatcgtaaacggaaaaggttcattcttcgcagaacaaacctttcaagggacaaaaatcgtcaaagcaaaggaggctgtttcatgagcagcttgtttcaaacctacggccgttgggatattgacatcaaaaaagcaaagggaacgtacgttgaggatcaaaacggcaaatcataccttgatttcattcaggggattgcggtatcaaatctaggacactgccatgaagcggtgacagaagcagtcaaaaaacagcttgacagcgtatggcacgtatccaacctgtttcaaaacagtctccaagagcaagcagcgcagaagctggcagcgcatagtgcaggagatcttgtctttttctgcaacagcggcgcagaggcgaatgaaggtgcgataaagcttgcccgaaaagcaactggaaaaacaaaaatcatcacttttcttcagtcgttccatggccgcacgtatgcagggatggctgcgaccggacaggataaaatcaaaacaggcttcggcccgatgcttgaaggctttcactacctgccatacaatgatccttctgcttttaaagctcttggggaggaaggcgatattgccgcggtgatgcttgaaacagtgcagggagaaggaggagtcaatccggcgagtgctgaatttttatcagccgtacagtcgttttgcaaggaaaagcaagcccttctcatcattgatgaaatccagaccggcatcggacggacgggaaaaggcttcgcatatgagcacttcggactctcaccggatatcatcacagtcgccaaaggattgggaaacggctttccggtcggcgctgtcatcggaaaaaaacagcttggagaagcgtttacccctggttctcacggaacgactttcggaggaaacatgctggcgatggctgctgtgaatgccacattgcaaattgtattccagcctgactttttgcaagaggctgctgacaaaggagcgtttttaaaaggacagcttgaggcagagctaaagagcccttttgttaaacaaatccgaggtaaaggattaatgcttggaattgagtgtgatggcccggttgctgacattattgctgaattgcagacattaggcttgcttgtattgccggccggcccgaacgtgattcggctgctgccgccgctcaccgtgactaaggatgaaatagcagaagccgtcagcaagctgaaacaggcaatcgctcatcattccgctgtaaaccagtgattttttttcgatataaaggcataaaaattcatttttataattaattattcatcaagaggtgggctgttagatggaaggttatttagtgttagaagatgggacatcgttcagcggcgagctggacggccatgaaaactgtacgggagaagctgtttttttcacaggaatgacaggctaccaagaagtgctgacagatccatcatataagggacagattattgtatttacctacccgctgattggcaactacggcataaatgaaaaggattttgaaagcaagaaaccgcaagtaaaagccgcagttgtctatgaggcgtgtgatcacttttctcattatgaagcggtatacagcctcaaggagtatttacagaaatggaacattccgctgttaacccatgttgatacgagggctgtcgtgaagaaaatccgggcaaacgggacgatgggtgcgtcagttacagcctctaaagaaggagctgagattgcccttcaaccagagaatgtggcagagcaggcttcagcccaggaaatcagcacatttggtgacgggaataaacatatcgctctcattgattttggctataaaaagtcaatcgcatcatcacttgtcaaaagaggctgcaaggttaccgtggtgccataccagcaaatggaggccgtatacaacatcaaacccgatggcattgtgctatcgaacggacctggagatccgaaagcaatccatccatatttaggaaagatcaaaagcatcatcagccgctttccgactctaggcatttgtctcggacatcagctgatcgcgctcgcgtttggagggaatacttttaagctgccattcgggcacaggggagctaatcatacggtcatcgaccgtgagacgaaacgggtctttatgacaagccaaaaccacagctatgtggttgatgaacagtcgattaatgaagaagagctcaccatcaggtttcatcatgtcaatgatacgtcagttgaagggcttgcccataaaaaactgcctgtcatgagtgttcaattccacccggaagcccatcccggacctgcggaaagcgaatggatttttgatgattatctaaagaatgtgataccagcaaggagagaaatcgcgcatgcctaaagacaccagtatttcaagcatattagtaatcggctcaggcccgatcatcatcgggcaggcggcagaatttgattattcaggcactcaagggtgcatcgcgctgaaggaggagggctatcgggtcattctcgtcaacagcaatccggcgacaattatgactgatgaagccttcgctgatgaaatttattttgagcctctgacagcagaaagcctgacagccatcattaagaaagaacggcctgatgggcttcttgccaatttaggcggtcagacagcgttgaatttagcggtggagcttgaagaaacgggtgttttaaaagagcacggcgtcaagctcctcggcacatccgttgaaacgatacaaaaaggagaggaccgggaaaaattccgttcgttaatgaatgaattaaaacagcccgtgccggagagtgaaattgttgataacgaggccgatgccctccattttgcggaatccatcggttttcctgttattatcagaccggcttacacattaggcggaaagggcggaggaatcgcccctgataaagaagcctttacagctatgattaagcaggcgctattagcaagcccgatcaatcaatgccttgtcgaaaaaagcattgccggctttaaagaaattgaatatgaagtcatgcgtgacagcaataacacatgcattaccgtctgcaatatggaaaatatcgatccggtcggcgtgcatacaggtgactctattgttgtggcgccgtcacaaacattgacagacgaagactatcaaatgctgcggacagcaagtctgacgatcatctcagcactcgatgttgtaggcggctgcaacattcaattcgcgcttgatccattcagcaagcaatattacgtcattgaagtgaatccgcgtgtaagccggtcatcggctctcgcatctaaagcgaccggttatccgattgcgaagatggccgcgaaactggcagtcggatacacccttgacgagctgaaaaatccgctcacaggctcgacttacgcaagctttgaaccggcactggactatgtgatcgtcaaatttccgcgctggccgtttgataaattcaaaaacgcagaccgcaagcttggcacaaaaatgaaagccaccggtgaagtgatggcgattgaacggaatttagaagcggcgatacaaaaggcagccgtgtcgcttgaattaaaaaatatcgggacacaccttccagagctcagcgggttgtcaattgatacgctatgggatttggcaatcactccggatgaccgcagatttttcgttgtcatggagctgttgagccgcagcgtctcgattgatgacatccatgaaaaaacaaaaattgatccgtttttccttcatacctttgacaacatcatcaaattggaaaaccgcctgatggaagcagggagcgatctctcttttgaattattgaagaaagcaaaggaaaagggattctcagacgcaacgattgcctcgctgatcggcaaaacagaagaagaggtgcgcgcgcttcgcaaggagatgggcattacgccttcctttaaaatcgtagatacatgcgcagcagagtttgatgcgaaaacaaactatttttactccacatatttcggagagaccgatggagacatcagccgcaaagagaaaaaacgcgcgctcattatcggatcaggcccgattcggatcggccaaggcgttgaatttgattatagtgctgttcacggtgtgctgacactgcaagagcttgggttcgaaaccatcatgattaacaataacccggaaacggtcagcacagattatgaaattgcggatcgcctgtattttgaaccgatgacaacggagcatattgtaaacgttgcggagcaggaaaatattgattttgcaattgtgcaattcggcggccaaactgcaatcaatgctgctgaagcgctcgaaaaagccggcattactcttcttggcacatcatttcaaacgctcgacgtgctagaggatcgggatcaattctatcagcttcttgacgagctgggattgaagcacgcaaaaggagaaattgcttatacaaaagaagaagccgcttcaaaagcgagtgagatcggctatccggtgttaatccgcccatcttacgttatcggcggaatgggcatgatcattgttgactcgcaagaccagcttactcagctgctgaatgatgaggacagcatgccatacccgattttgattgatcagtatgtgtctggaaaggaagtcgaaattgatttgatttccgacggcgaggatgtctttatcccgacatataccgagcatattgaacgggcaggtgtccattcaggggacagctttgccattcttcccggaccgtccatcacgagcgggctgcagcagggcatgaaagatgcggcacaaaaaattgcccgaaaactttcatttaaaggcatcatgaacattcaatttgtgatcgacaatggaaacatactcgttcttgaagtgaatccgagagcgagccgcacggttcctgtcgtcagcaaagtaatgggcgttccgatgattccgctcgccacacgtctgctagcgggagcgtccttaaaagatctaaatccggcagttcaaaatcatcatggagttgccgtgaagttccctgttttttcttctcatgcgatccaggatgtggatgtcaagcttgggccggaaatgaaatcaacgggagaaggcatgtgtgtcgcatatgattctaacagcgccttgaaaaaaatctatacaagagtctggagtcaaaaaggaagcatttatttgcaaaacgttccggaagatgtgagggagttagcagaaaacgcaggttttacaattcatgaaggggcatttgcctcttggatggaacaggaagggaaatcgctccacatcaatctgagcggttctgaagaagcacgcaaagaacgtttggaagccatgacgcacggcatccccgtctttacagaagaagaaaccgtgcgggcgtttttacaaagcggttcaggccatccgcagcctgtatctctcaaagacctctataaaaaggaagtggcaacatgcacacagtgacgcaaaccagtttatacggaaaagatttattaacgttaaaggaccttagtgaagaggatataaacgccttgctcgcagaagccggtgagctgaaacaaaacaaaattcagcctatattccatggcaaaaccttggcgatgatttttgaaaaatcatcaacgcggacacgtgtttcatttgaagcgggcatggcgcagcttggcgggaacgccctctttctaagccagaaagatctgcagctggggcgcggtgagactgtcgctgatacggcaaaagtgctgtcaggctatgtggatgccatcatgatccggacctttgaacatgaaaaggtggaggaacttgccaaagaagctgacattccggtgatcaatggacttactgataaataccacccatgccaggcgctggcggatctcttgacgattaaggagataaaagggaagcttaatggcgtaaaagtcgcatacatcggtgacggaaataacgtggcgcactccttgatgatcggctgcgcgaaaatgggctgtgatatctcaatcgcttcgccaaagggatatgaagtgttagatgaagcagctgaagcggcaaaaacatatgcacttcaatccggctcttctatcacgctgacagatgatccgattgaagctgtaaaagacgcagacgtgatttattctgatgtgtttacaagcatggggcaggaagcggaagagcaagaacgtcttgctgtctttgcgccttatcaggtgaatgcggcgcttgtcagccatgccaagcctgactatacatttttacattgtctccctgcgcatcgtgaggaagaagtgactgcggagattattgacgggccgaactctgcagtgttccagcaggcggaaaaccgtcttcatgtgcaaaaagcactgctgaaggccattttatacaaaggggaatcatcaaaaaactgctgagccaaactcagcagtttttttgatggcaacatattcacagccgcttaggcgcatactacagcaaaaaggaaaaggaggaaaaacagtgggacagcagcaccaattccggcccggacagaaagcgcctaataacggtgtctacgtagaaatcggcgagacagggagcatggttaaaaaccctcaaaaggtccatctgtcagcaggggaaatgttccccgaaacatcaaaccacaaccggctgtggacttacaaaagaaagccgtgaccactaaaaaacccaaaacaataaatgttttgggttttttggctttttaatgctggcttgcatttttgttcataggcatgatttctgctaaaaccatgattaagacatacagtacaacagcaatgacagatgatgttttgaaattatacgtaacgctgttcatgcttgcaaccaagtagcatgccatatgtgataaaaggaacgtccaaataaaggcaataatatatcgcacgtttccacctcgtccttctcattctattctaaaagttatcataccatacaaaaagcgaaggggaaatccaattttagcagaaagtgaggtgacaaaagagtctgattcgtcacactttaatggtaaaatataaaaaacgtcaatcagtataatagccaaaaatgtaaaaggctaggactttaccttattcgtttcttttctatttacataagatagcgtgagatgaagtgtgaaaggaggcgggcaagcgatgggaataacggaaagatactttcaactgggaacggagcataatgtcattcatctgccctatcgcccgaacggcttcggcatctttatcttgggggacagaacccactttgtcggacatgattcaagcttttggcagcagcattacggcagaaatcagcttctgagcatgttgatgaatgaaggatatactctttttaacagcaatctgttcggaaggcattgggggcggaaaaagcagtcacctatgccaaacagctgatacattctgtgctgaagcaggaaatcctcaatccgaagattcatattttagcagaaggcatgggtgctctcgtggccgatgaactgcttcgtttttccccggatcatatccgctcagccgcaatgttgaatccttgtctcgatcttcaggcacattatgaatcggaaaaagaaaataaatttttctataagcaatttttgaaagaagtatcgaaaagctacggaatttctgaaaaagaagcggaagcgcttcgttataaaacaattcaaagctacccgagcggcgtaccggttcatatatggcagcgtatgaccggatctccatatccctacagtgtacatgcagaagttttcaaggaaaaacagcaaaagcaaggctcaccggtcgacatgacatttcatttatttgagcatccaagcagaatttatgcatcaatttgcaaattctttcacagtcatgaaaaagaattatagagaatataatgacaacagccttctcttttgcggaggctgttttgttttgggaaatgaaaaaccggaagggcggcagatgcaatggaatcaacgctgattgtaggtgcggacgaatttttcggcctttcattatgtgagcgaatgatggatgaaggcatacatgttgacgttgttctggcggaaacagaagataaaatgagacaaatgtacttagaagaaagactcatgtggcttgggagaaatgaactctttcgccagcttgaacacattggagaccaaaattatgatacaatttgtatccagttcggaagttttttgcctttagaccaatgtgattctccttatattttagtatatgaagaagaccgaaaagaatgggaaaaacgtgaaaaaacaggctcggaaaaaaccgtgatcctgccgaaaatgtatgggccatggaaagaagaaacagaggaagacggctattacacaaacgacgtcgctgacgagttgctgagattcctgttagaaccaagccgtcatagcaaagatcagctttttgaattgcaagtcacagagaaaatctcaaaagaagaagcaaaaacaaaaattatcgagtggaaaagacaattttcatcaattttcgacaaatattaagaaaaaccttccatgtttcgagttttctagatacaataaacgtataaaaataaacatgttatagcttgtcaaaaggagttgaacatgacttgatcacaaggcttgtcatgatcttttctgtcctccttttattgagtggatgtggacaaactccgttcaaaggaaaaattgagaaggtcggcatgctctttcctgatacgattaatgacctcgtatggggcacaaaagggtataaaggattactgaatatacaatccaaatacaatgtggacgtctattataaagaaggcgttaaaacagaagaagatatcataaatgcgattgaggattttcataagaggggcgtcaatctgctctacggccatgggagtgaatatgctgaggtgtttaacttggtcggcgaagattatccagatatggaattcgtcatttccaatgcgaaagcgaaagctgataatgtaacgagtgtccattttagcggggaagcaatgggcttttttggaggaatgactgctgcccatatgtcgaaaacgaatcaggtcggtgtaattgcctcctttacgtggcagcctgaggttgatggttttatcaaaggggccaagtatgaaaatccggatatagaggtaaatacgaaatatacggatcattgggatgatgatacaacagcagtaaagctttatcagaaaatgaagaacgaaggcgcggatgttgtgtatcccgccggagacgggtataatgttcctgttattcagcaaatcaaaaaagacggtctttatgccattggctacgtcacagatcaatcggatctgggcgagaataccgtattaaccagcacggtgcaaaatgtggacaaggcctatgaaatcattgctgaacaatttaataaaggcacccttgagggcggcgatcattactacgacctgaatacgggagtcgttgagatgggaacattcagcccgctcgtcgacaaagactttcagcaaagaatcgccaagctgatcaaaacatacaacaaaacaggcgagctgccaaaaaacgaataatggagtgacgtcacatgcagcacgaaaaatcacttgaattcttgcaaattgccatgaaatatctccctgaagcgaaagaacagcttgagaaatcaggcattgagctctcaatggaggccatccagccgtttatgaatctatttacaacggtaatggcggaagcttatgagcttggcaagtctgacgctaaatctgaaacagaataagaagaagccacttttttgaaagtggcttttcacatgattttctttttaatagcggagagcatgggcgcaagctcctttaaagcgggcttgatttgatcaagagagttcataattgaaccgatttggtccataatatgcatgtaatgaatcgtctcttcgtcgtttgtctgagaaacctgagaaacctcctcttgctgttcctccttctcttctgttggttttgctgcatcgccgaacatcattcttgaaaacacatccaactgcatacgcctcctttccatataccatactctatgagtaagatgaactgatagtttagacgaatatattgccatgtgaaaaaaaataggatagaattagtacctgatactaataattgatcacaacctgattgatcttctaaatttaagatataaaggagtcttcccttatgaaagctggaatacttggtgttggacgttacattcctgagaaggttttaacaaatcatgatcttgaaaaaatggttgaaacttctgacgagtggattcgtacaagaacaggaatagaagaaagaagaatcgcagcagatgatgtgttttcatcacatatggctgttgcagcagcgaaaaatgcgctggaacaagctgaagtggctgctgaggatctggatatgatcttggttgcaactgttacacctgatcagtcatttcctacggtctcttgtatgattcaagaacagctcggcgcgaagaaagcgtgtgctatggatatcagcgcggcttgtgcgggcttcatgtacggggttgtaaccggtaaacaatttattgaatccggaacctacaagcatgttctagttgtcggtgtagagaagctctcaagcattaccgattgggaagaccgcaatacagccgttctgtttggagacggagcaggcgctgcggtagtcgggccagtcagtgatgacagaggaatcctttcatttgaactaggagccgacggcacaggcggtcagcacttgtatctgaatgaaaaacgacatacaatcatgaatggacgagaagttttcaaatttgcagtccgtcaaatgggagaatcatgcgtaaatgtcattgaaaaagccggactttcaaaagaggatgtcgactttttgattccgcatcaggcgaacatccgtatcatggaagctgctcgcgagcgtttagagcttcctgtcgaaaagatgtctaaaactgttcataaatatggaaatacttctgccgcatccattccgatctctcttgtagaagaattagaagccggtaaaatcaaagacggcgatgtggtcgttatggtagggttcggcggaggactaacatggggcgccattgcaatccgctggggccgataaaaaaaggtgaggtgcacacaagatgactaaaaaaagagtagttgttacaggacttggagcattatctccacttggcaacgacgtcgatacaagttggaataacgcaatcaacggtgtgtccggaatcggtccgatcactcgtgttgacgctgaagaatatccggcaaaagttgccgctgaattaaaagattttaatgttgaagattatatggataaaaaagaagccagaaaaatggaccgctttacacaatatgcggttgtggctgcgaaaatggcggttgaagacgcagatcttaacattaccgatgagatcgcaccgagagtcggtgtttgggtaggctccggtatcggaggacttgaaacactagagtctcaatttgaaatcttcttaacaaaaggtccaagacgggtaagcccgtttttcgtgccaatgatgattcctgacatggcgacaggccagatttctattgcattaggagcaaaaggggtgaactcttgtacggttacagcatgtgctacaggaacgaactccatcggtgacgcgtttaaggttattcagcgcggtgatgcagacgtgatggtcacaggcggaacagaagcgccgctgacaagaatgtcattcgccggctttagtgccaacaaagcgctgtctactaatccagatccgaaaacagcgagccgcccgttcgataaaaaccgtgatggttttgtcatgggggaaggtgcagggattatcgttcttgaagaacttgaacatgccctggcccgcggcgctaaaatttacggagaaattgtcggctacggttcaaccggagacgcttatcatatcacagcgccggcccaagacggtgaaggcggagcgagagcgatgcaagaagccattaaagatgcaggcattgcacctgaagaaattgattacatcaatgctcacgggacaagcacatattacaacgacaaatacgaaacaatggcgattaagactgtttttggcgagcatgcgcataaacttgcggtaagctctacaaaatcgatgacaggccacctcttaggagcagccggcggtattgaagccattttctctatcctggccattaaagaaggcgtgattccgccgacaatcaatattcaaacgcctgacgaagaatgcgatttggattatgtgcctgatgaagcccgcagacaggaacttaattatgttctcagcaactcattaggattcggcggacacaacgcaacattaatctttaagaaatatcaatcataatcaagccaaaccggctgcccttaaagggtagccggttttttttgtgtgcataggattaaaagaggaggcgatcacatgagtgtagaacaaacatatagctggctcaggaaggctgattcaatagatgatttggcgcattatattatcccgcttttttcaggtgcggagaaaaagaactggaagggcattctagggcatcttcagcatcatgggatgtttaaaaacataaaagagggtattcagactgtttccaagctgaaggaaaaaggtttttacggacatatccaaaaggaagaacagtacctcaaaaacaaatggcaaggtcctgatgtaccaattgtcacgctgccggttgatgaacgaaacaggagaatccgtttagaattcggatcaaaatcaggactcgcctttcaagacaaaatgttcctttttctttcgtcagatttagattttgggtcagtatctgcccttatgacgcatgagtatcatcacgtttgccggttaggtcatctgacaaaagaggaaaaggatgtcacattacttgatacaatcatcatggaagggctggcggaatatgctgtttatgagaggttcggccgaagtcaaacggctgagtggacgacttggtatacaccggagcagcttcaggctttatatgaaaaaaagattgcgccccatcaggatatcaaacgggataatcgattatttccccagctgttattcggcaaaggatatcagccaaaaatgcttggatacgcagttggattcaatattgtaaaaaaatatttaactgccagcaaggcaagcaccgcagacgggctgtccattcctgctgaaacctttttggatgcaatgctttaaaaggataaaataatggaatttcattaataatattacatttatcctaaaaaattcttgattttgcaaaatgattgtaataatatacaactataaaatttttcgataattcaatattatttattatttctgaataaagggattgctttctcttgaaaacgtttgacaacaagagggggaaaggggagctagcatgagcacacttttagaagtgaataatttaaagacttattttttcaggaaaaaggagccgatccctgcggttgacggagtcgattttcacatcagcaaaggcgaaaccgtcgcgcttgtaggtgaatcgggctccggaaaaagcattacttctttatcaattatgggcctcgtccaaagctcaggcggaaaaatcatggacggctctattaaactcgaagacaaagacctcacctcattcactgaaaacgattattgcaaaatccgcggtaacgaagtatccatgatctttcaggaaccaatgacctcccttaatccggtgttaacaatcggagaacaaattaccgaagtgctgatttaccataaaaacatgaagaaaaaagaagcccgtcaacgagctgttgaactcttgcagatggtcggtttctcccgggcggagcaaattatgaaggagtacccgcatcggctgtccggcggtatgagacagagggtgatgattgccatcgcactgagctgtaatcctaaactgctgattgccgatgaaccaacgacagcgctggatgtgacaatacaagcccaggtgctggaactcatgaaagatctctgtcagaagttcaatacatcgattcttctcatcacacacgacttaggtgtcgtgtctgaagctgccgatagagtaattgtcatgtactgcggacaagtcgtagaaaatgctaccgttgatgacttatttttagaaccgcttcatccgtatacagaaggcctgcttacgtcaattcctgttatagatggagagattgataaattaaatgcgattaaaggcagtgtgcctacaccggataatctgccgccggggtgccgttttgccccaaggtgcccgaaagctatggataagtgctggacaaatcagccttcgcttttgacacacaaaagcggaagaacggtgagatgctttttatatgaggaagagggtgccgaacaatcatgacagcagctaatcaagaaacaatcttagagcttcgtgacgtaaaaaaatactttccgatccggtcaggcctttttcaaagaaaagtcggtgatgtaaaagcggtggatggtgtttcattttcgttaaaaaaaggagaaacactcggaatcgttggagagtcgggctgcggaaaatcgactgccggcagaacgatgatcagactgtacaaaccgacagagggccaaattctttttaaagggcaggatatttccaatctgtcagaggagaagctgcggaagagtgtccgcaaaaatattcaaatggttttccaagatccatttgcttcgttaaacccgagaaagaccctgcgttccatcataaaggagccgtttaatacgcacaacatgtataccatgcgtgaacgaaacgaaaaagttgaagagctgcttgcaagagtagggcttcacccgtcgtttgccagccgttatccccatgagttttcaggcggccagcgtcagcggatcggcattgccagagcactcactttgaatccagagctgatcattgcagatgagccggtttccgcacttgatgtatccattcaggcccaagtgattaacttgatggaggaattacaggaagaatttaatcttacgtatctatttatctctcatgatctgagtgtcgtacgccatatcagcgacagagtcggagtaatgtatcttggcaaaatgatggagctgaccggcaagcatgagctttatgacaacccgcttcacccatatacccaagcgcttttatcctccgttccagttacaagaaaaagaggatctgtcaaacgtgaacgcattgtcctgaagggagaactgcctagtccggccaacccgccaaaaggctgcgtattccacacaagatgtcctgttgcaaaaccgatatgcaaggaacaaataccagaatttaaagaagctgctcccagccactttgtggcttgtcacctttatagctaatgttgcccgcacagctttgagagggggtatgcacactacataaacaacagctgagaagaacgaacatttcaagaggggaaatatctaatgaaaagacggaaaaccgcactgatgatgctaagtgtattgatggttctggccatctttttatcagcctgctcgggatcaaaatcaagcaacagcagcgagaaaaaatcagcaggcaaaccgcagcaaggcggggatttggttgttggttcaatcggagaacccacactttttaactctctgtattctacggatgacgcaagtacggatattgaaaatatgctgtacagctttttaacgaaaacggatgaaaaactaaatgtgaaattgtcactcgctgaaagcattaaagaattagacggcggccttgcatatgatgtgaaaattaaaaaaggcgttaagtttcatgacggaaaagaactgactgcagacgacgtcgtatttacgtacagtgtccctttaagcaaagattacaagggagaacgcggttcaacatatgaaatgctgaaatccgtagaaaaaaaaggcgattacgaagtcttgtttaagctgaaatataaagacggtaatttctacaacaatgcgttagacagcacagctattctgccgaaacatattctcggtaatgttccgattgccgatttagaagaaaatgagtttaacagaaagaaaccaatcggttcaggaccatttaagtttaaggaatggaagcagggccaatatattaagctcgaagcgaatgatgattactttgaaggaagaccgtatttagatactgtgacgtataaagtcattcctgacgcaaatgctgccgttgctcagctgcaggcaggcgatattaatttctttaatgtgcccgccactgactacaaaacggctgaaaaattcaacaacctaaaaatcgttactgatttggcattaagttatgtgtacatcgggtggaatgaaaaaaatgaattattcaaggataaagaggttcgtcaagcgctgacaaccgctcttgaccgcgagtcaatcgtcagccaagtattagatggagacggcgaggtagcttacattccggaaagccctttatcttggaactatcctaaagatatagatgttccgaaatttgagtacaacgagaaaaaagcgaaacagatgcttgcagaagccggctggaaagatacgaacggtgacggcattctggataaagacggaaagaaattctcgtttacccttaaaacgaaccaaggaaacaaagtccgtgaagacatcgctgtcgtcgttcaggaacagctgaaaaaaatcggcattgaagtgaaaacccagatcgttgaatggagcgctctcgttgaacaaatgaatcctccgaattgggattttgatgcaatggtcatgggatggagtttatccacattcccggatcaatatgatattttccattcaagccagattaaaaagggtttgaactacgtttggtataaaaatgccgaagcggataaactcatgaaagatgcaaaatcaatcagtgacagaaagcagtattcaaaagaatatgagcaaatctatcaaaaaattgcggaagatcagccatatacgttcttgtattatcctaacaaccatatggcaatgccggaaaatcttgaaggatacaaatatcatccgaaacgtgatttgtataatattgaaaaatggtggcttgcaaaataaatttcccttaaaggggagggagagcgttttctccctcttctgtttttaataaggaaagtaaagggggacaagtatatggctgcatatattatcagaagaaccttaatgtctatcccgattttattgggaattacgattttatcatttgttatcatgaaagccgcgcccggagatccgatgacattaatgatggacccgaaaatcagccaggctgacagagagcagtttattgaaaaatacggtctgaatgatcctcagtacgttcaatatttaaagtggctaggcaacatggtgcagggtgatttcggaacgtctattgtcagaaaaggaacgcctgtttcagaattgattatggcaagactacccaatacgctcctgctgatgctggtttcaacgattttggctcttatgatttctattccgttcggtgtcctgtcggcaaagcggccgtattcaaaaatcgactatggcattacatttacctcgtttataggcctggctattccaaacttttggtttggattaattttgattatggtgttatctgtaaatctcggctggtttccaaccgggggtgtcgagacgctgaataccgaattcaatatatttgaccggattcatcatttaattctgcctgcattcgttctagctacagctgacatggccggactgacgagatacacgagatccaatatgcttgatgtattaaatcaagattatattcgcacagcaagagcaaaaggatttaaagagaacagagtgctatttaaacatggattgaggaatgcattattacccgtcattacaattttcggtttgatgattccttcatttatcggcggatctgtcgttgtcgaacaaattttcacttggccgggattaggaaagctgtttgtcgattcagcattccagcgcgattatccggttatcatggcaatgactgtgatctcggcggttcttgtcgttgtcggaaacctcattgcagacatcctttactcgattgttgatccgcggatcgaatattaaaaggagggaaacagagatgtcagagctgcaaacaactccctcgccggagatcaggctgaaagaaaatatttcgaaaaagccagaaacaatgacaaagattttctgggaaaaattctcgaaaaacaaactggccattttaggtgccgttattctttttatcattattatgtctgctgttttcgcccctttaattgcaccttatccccaagagcagcaaagcctgcttgataaatataaggcgccgggccttgaacatctgatgggaacggataaatttggacgtgatattttcagccggatcctatatggagcgcgtgtctctttattggttggatttgcgtccgtagtcggttcgattttgatcggaactgttttaggagcattagccggatatttcagaggaatagtggatgctgtcattatgcgtgtagttgacattgtgttatccattcctgatattttcttgttgatcacgctggtcaccatcttcaagccgggtgtggacaaactgattttaattttctgtctcacaggatggaccacaacagcacgattagtaaggggagaattcttgtcgctccgttcaagggaatatgttcttgctgctaaaacaattggaacaaaaacgcacaaaattattttttctcatatcctgcccaatgcgttaggaccgattattgtgtcagctacgctgaaagtagggtctgttattctagctgaatcggcgctaagctacttgggctttggaatccagccgccaatcgctagctgggggaacatgcttcaagacgcacagaatttcacagtaatggttcaagcatggtggtacccgttatttcccgggctatttattttaatgaccgttttatgcttcaactttgtcggtgatggcctgcgggatgcgcttgacccgaaaaatattaaataaaaatgaatatcatatctgtgataaaatatcaccaaatcagaaaaaaagcaggtctccttttgttagaaaatatacaaagagatctgctttttgcgattcttacataaaactagtgattccagatttcctcaatctctttggaataatttctctatcccttgcctatactgtggacaacagtttttataaaagtgaggggttagagatgttatttcttcatgatgtgtgggtcaattggtttgaaggggaagaaaatggctacaatgtatgccactttcacgaatggcgcaaggaagatacggttgagcttttggatcaggtgccgctgttaagggtgccgtcagtactgtttcattacatagaaaacgatttgtcagagcttccgaaaggtttgcttgaagacgtacatcagaaatcgtacattcggaaaaatcatgagcggacaaagcttgagtattgttttgtcgtaacagacggaatcggcattttagctgtcgacacgatcggctacacgatccctgtcagaaaaagccgtctgatcccaagacaggagcagctcgtttatgaaatggtaaaagatgtagagcctgaaacatatgaatttgagccaaagaagctggaatcctccaaggaatatcacatcttatcattagcaccagaacatgtcagaggactgacaagaaaagaacggcaaattaagcagctgatgtttatggcgcttgaccaattaaaagggctgaaaaaccgggcggaaattggctactggtacacagagtggaatccgcatatgtatgaacaaatcaaaaggatgagctttgaagagatttgggacatgctgtataacgaaacaattgaaggctggtcggacaaacacctagctttttgcgaaaacctaataaaaggacagccttttttcgaaaagttatgggaaatggaaaacgaatcaaaggtcaactgaaaaaaaccgctctttgcaaagagcggttttttgattagcgtctttttcttccaagacccatggcattctccatttttttcagcattttgtttgctgtccgattcgctcgttccgcgccttcatcaagaatccggtctaattcttcagattctaccagctcgtaatagcggtcctggatcggttttaatgcgttcaccacgacttctgccaaatcacctttaaactcgccgtagccttttccttcgtattttgcttcaagctcttcaattgtcgtattgccgaggattgaataaattgtaagaaggttggaaacgcccggtttgttttccttatcaaatttcacaatgccttcagaatctgtcacagcgcttttgattttcttttcaagaagcttcggttcatccagcagggtaatataagctttctgattcggatcagatttgctcattttcttcagcggatcattcagagacatgatacgtgcaccgacttttggaattttcacttccggaatcgtaaagatgtcgttgtattttttgttgaagcgttctgcaagattccgcgtcagctcaaggtgctgcttttgatcctcgccgacaggtacaagatccgttccgtacagcagaatatcagcggccatcagcggcggatacgttaacaggccggagacgacagcttcattgcctttggatttgtccttaaattgagtcatccgctcaagctcgccgatatatgcgacacactgcatcatccatccggcctgcgcatgcgcgggacctctgactgaataaacaatgttgctttttctggatcaagtccgacagctaagtaaagcgccgcgagattgcggatattctttctaagctcaagccggtcttgaggaacggttatcgcatgctgatcgacgatgcaaaaatagctgttataatcatgctgcagctcgacaaactgcttcattgcaccgatatagttgccgagcgtcactgagccgcttggctgaatgcctgaaaaaatcgtttgtttcatgaaaacatcaacctcatttcttaaaacataataaaaaaggctcattcttcccctgtaaaaaagggacgaatgaaccgtggtaccaccctgattattccattaaaatgaaatcactctgacgtttgtaacggagactgctccggctgagcctacttttttccagttcggtcagctgctccaaagtccattccacattgcccgttatctgctctcagcaccgcagactctcttcaaacaggtgaaatgtgtactactctttttcatagcaagcttttcttttgattgcttcattataaatcaattataaccaattgtcatcatgaaaaaacattcttttttccagtaaaattgtaataatataaataacacgggtgctgtaaaatccttaaatgataactgctatcatcgtaaaaacaggcagatattatatgtaaaaagcaatatgggcagaaaacacatgaaaaagtttttaatcaatttatgctttaaatggtagaaggatattatgttcatggaagaaaaactaacgaagtttaaatattttaaattgataaaataatattgcaataaattatttgtttcattataatgaacttgttcactctattgttacagcttttttacaaaaataatcagaaaagacggaacagaataaaagttgtggaaactcaggttcatttgtctgatatttctgaggatttagccgtaaggagctgaaaattattattagggggtttgcgaatatgaaaaaacgttggtcgattgtcacgttgatgctcattttcactctcgtgctgagcgcgtgcggctttagcggcagcggatcaaacggtgaggggaaaaaggacagtaaaggaaagacgacacttaacattaatattaaaactgagccgttttccttacatccgggattggcaaatgattcagtatcaggcggtgtcatccgtcagacttttgaaggattgacacgtatcaatgcagatggtgagcctgaagaaggcatggcttctaaaattgaaacgagcaaggacggaaagacatatacatttaccattcgtgatggtgtgaaatggtctaatggagaccctgtaacagcacaagattttgaatatgcttggaaatgggcgcttgatcctaataacgaatcgcaatacgcttaccagctctactacataaaaggtgctgaagcggcgaataccggcaaaggcagcctagatgatgtggcagtaaaagctgtgaatgacaaaacgctgaaggttgaattaaataacccgacgccatatttcactgaattaactgcgttctatacgtatatgccgatcaacaagaaaattgcagagaaaaataaaaagtggaatacaaatgccggagatgattatgtatcaaacgggccgttcaaaatgacggcatggaaacacagcggctctattactctcgaaaaaaatgaccagtattgggataaagacaaagtcaaactgaagaaaattgatatggttatgatcaacaataacaatacggaactgaaaaaattccaagctggcgaacttgattgggccggtatgccgctcggacagcttccgacagaatccctgccgaccctgaaaaaagacggttctttacatgttgagccgattgcaggtgtgtattggtacaaattcaacactgaagctaagccattagacaacgtaaatatccgtaaagctttaacatattcgcttgaccgtcagtcgattgttaaaaacgttacgcaaggagaacaaatcccggcaatggctgcagtgccgcctacaatgaagggatttgaggataacaaagaaggatacttcaaagacaatgatgtcaaaacagcaaaagaataccttgataaaggcctaaaagaaatgggcttaagcaaggcatctgatttgccaaaaatcaaattgtcttacaacactgatgacgcacacgcgaaaatcgctcaagcagtacaagaaatgtggaagaaaaatttaggcgttgatgttgagcttgataactcagagtggaatgtctatattgataagctccacagccaagattatcaaatcggccgtatgggctggctcggcgacttcaatgatcctatcaacttccttgaattgttccgcgacaaaaacggaggaaataacgatacaggctgggaaaatccagaattcaaaaagcttctgaatcagtcacaaactgaaacagataaaacaaaacgtgcagagctgctgaaaaaagcagaaggtattttcattgatgaaatgccggttgccccaatctatttctatactgatacttgggtacaggatgaaaacctaaaaggtgttatcatgccaggtactggtgaggtttatttcagaaacgcatattttaaataaagctacgtctgaaaataaaagacctcaaggtatatggggagaaaagccccatatacctttcttactgatggagtataaaaatgtaaaaaccatggaggtgttcccccttgctaaaatatatcggaagacgtttagtctatatgattatcacactatttgtgattgtaactgtgacattcttcttaatgcaagcagcaccgggcgggccattttcaggtgagaaaaagcttccgcctgaaattgaagcaaatttaaatgcgcattatggcttggacaagccgctgtttgtacaatatgtcagttatttgaaatcagttgcaatgtgggatttcggaccgtcatttaaatataaaggtcagagtgttaacgacctgatcagttcaggtttccccgtttcatttactcttggagcagaagctattctcctcgctttagcgttaggtgtattgtttggggtcattgcagccctttaccataataagtggcaggattataccgtcgcgattttaacgatatttggtatttcggttccgagctttatcatggcggctgttctgcaatatgtgttctccatgaagcttgggctgtttccggtcgcggggtgggattcctgggcatacacctttttgccttcaatcgcacttgcttccatgccgatggcgtttattgccagactttcccgttcaagcatgatcgaagtgttaaacagtgattatatccgcacagcgaaagcgaaagggctgtcccgcccagcggttacagtgcggcacgccattcgaaacgcgcttttgccggttgttacatatatgggcccgatggccgcacaggtcttaacggggagcttcattattgaaaccatttttgggattccggggcttggtgcacacttcgtcaacagtattacaaaccgtgattatacggtcattatgggtgtaacggtgttcttcagtgtcatcttgctattgtgtgtattaatcgtagatgtgttatacggcattattgatccaagaatcaagctttccaaagcaaagaaaggagcctaggccatgcagaacattccaaaaaacatgtttgaaccagccgcagcgaatgccggcgatgcagaaaaaataagtaaaaagagcctttccctctggaaagatgcgatgcttcgcttccgcagcaataagcttgcaatggtcgggcttatcattatcgtacttattatccttatggcaatttttgcgccgatgttctcaaggtatgattattcaactactaatctcttaaatgcggataagccgccttcaaaagatcactggttcggaacagatgatcttggacgagacattttcgtccgtacatgggtaggggctcgaatctcaatctttatcggtgttgcagctgctattctcgatttgctgatcggcgtcatttgggggagcatttcaggcttccgcggaggcagaacggacgaaatcatgatgcgtatcgctgatatcctttgggcagttccttcattattaatggttatcttactgatggttgttcttccgaaaggtctatttacgattattattgccatgacgattacaggctggattaatatggccagaatcgtgcgcggacaagtgctgcagctgaagaatcaggagtatgtgcttgcttcacagacactgggtgcaaaaacatcccgtcttctgtttaaacatatcgtgccaaacgcgatgggttctattttggtcacgatgacactgacagttcctactgcgattttcacagaagcctttttaagctatttgggacttggtgttccggctccgctggcaagctggggaacgatggcttctgacggattgcctgcattgacctattatccgtggcgtttattcttccctgccggatttatctgcattacaatgtttggtttcaacgttgtcggcgacggattaagagacgcattggatcctaagttacgtaaataagggagtgatacgggtgacacgcctattagaagtaaaagatttagcaatttcatttaaaacatatggcggagaggtccaggcgatccgcggagtgaatttccatctggataaaggggagacgctggccattgttggagaatcaggttccggaaaaagtgtaacctctcaggcaattatgaagctgattccaatgcctccgggttatttcaaacgcggtgagatcctgtttgaaggaaaggatctggtgccgctgtccgaaaaagaaatgcaaaatgtccggggaaaagagatcggcatgatattccaagatccgatgacctctttaaatccaacgatgaaggtcggtaaacaaattacggaagtgctttttaaacacgaaaagatctcgaaggaagcggctaaaaaacgcgcggttgaactgctggaattagtcggtatcccaatgccggaaaagcgggtgaaccaatttccgcacgaattttcaggcgggatgagacagagggttgtcattgccatggcgcttgcagcgaatccgaagcttctgatcgccgatgagccgacaactgctcttgatgtaacgattcaagcgcaaattttggaattaatgaaggatttgcaaaagaaaattgacacgtccatcatctttatcacacacgatcttggtgttgtggctaacgttgctgaccgggtcgctgtcatgtacgcgggacagattgtagaaaccggtacggtagacgaaatcttctacgatccgagacatccgtacacttgggggcttcttgcatccatgccgacactggaaagttcaggagaggaagagctgactgccattccgggcacaccgcctgatttgacaaacccgccaaaaggagatgcttttgccctgcggagcccttatgcgatgaaaatcgattttgaacaggagccgccaatgtttaaggtatctgatactcattatgtcaaatcgtggctgcttcatcccgacgcgccaaaggtagagccgccagaagcggtaaaagcgaaaatgcgtaaactggcaaacacgtttgaaaaacctgtcttagtgagagaaggtgaatgaattgactgaaaaactattagaaatcaaacatttaaaacagcactttgtcacgccgaggggaacggttaaggctgtagatgatttatcatttgatatctataaaggtgaaacattagggctggttggtgaatctggctgcggtaaatcgacaacaggccgaagcattatccggctgtacgaagcaaccgatggtgaggtgctgtttaacggtgaaaatgtgcacgggagaaaatcgcggaaaaagctgctggaattcaaccgcaaaatgcagatgattttccaagacccctatgcatccctaaatccgagaatgacagttgctgatattattgctgaaggccttgatattcataagctggcgaaaacgaaaaaagagcggatgcagcgagttcatgaactattggaaacagttggtttaaacaaggaacacgcgaaccgctatccgcatgaattttccggcggccagcgccaaagaatcgggattgccagagctcttgctgttgatccggaattcattatcgcggatgagccgatttccgctttggatgtatccattcaagcgcaggtcgtgaatttaatgaaagaactgcaaaaagaaaaagggctcacatacctgtttattgcccacgatttatcgatggtcaaatacatcagtgaccgcattggcgtcatgtatttcgggaaactggttgagcttgcgccggcagatgagctgtatgagaatccgcttcacccgtatacaaaatcattgctttctgcgattccgcttcctgatccggactatgagagaaatcgcgttcgccagaaatatgatccgtctgtccatcaattaaaggatggggaaacgatggaattccgtgaagtcaaaccgggacattttgtgatgtgcacggaagccgaatttaaagctttttcatgatttatcaatccttcaagagaaatctcttgaaggatttttttacggcatcatagaaagtgagaatgatgacatttacaattagaggaaaaaagcggaggcgaaatacaattcaatttctgcataacaaaaatgtttttgcgctattgctgtctcaatctcttcaatctttagcaggagtcctcgtcacaatcgttttaatggtccgggtctatcaaatgactgactccgtttttttagcaagccttattttatcgttcatgtcgtttgcgagtatagcagcaagcttttgcgtctctccggtgcttcgcattctcggttttaaaaaggtgcttgcgggagcgaatctgctgagagcggtctttacaatcctgatggcatacagcgtcactcatcacggacaggcattcttttggattacgctgctgtttgtgttctgtttttccttcgcgggcgctttttttcagccggcaagatttgcgctgctgccgattattgttccaaagaagcaatatgtaaaagcgaatggtgtaatctccctctcgaatcaattgttcttaacagcaggctggggccttggaggccttctgacgtacgccgtcccttttgaacccgttgtcggcgctgccatttgcctgtttgttctatcgggagcttccatcagtgtgctgcatgtaaatgaagaagaggctgtaggaactgctgaaacagcatctgccagaagtatatggaaggatttaatgatcatccctattgtaagagacattactgtaatggacatgatagaagctttggcgggttccgtatggtcatctgctattctcctcgcatttactgcggctgttttgcacgaaacagaggtgtggtgggggatgtttaacgcttcctattttataggcgcaattgtcggcagtgtggttgccattcgtttttcttctttttttgagcggaatatgggctatgccattatgttcagctcgcttgtaatgtcggcgctgacccttttgttttcattttctccagtcccatttttatgcgctctggcttgtgctgcaatggggcctttttatcaggtgcgtgatatttgccaggaaaccatgctgcaggaggttattcccgagcagaaacgaatcggaatcatggctgcaaaaaatgcgattttgactccttggtcaggcgtcacctactccattatggggctagtggctgatgctgctggtgcgaaaatagcttttatcgcggctgctgcattatatatcatgacatttctgattgcactggcgcagccccgcctggttcattacaggcgggaaaatcgagttcaatgagaaacaattcaaaatgaacggagcagatggctcggtttttgctgaaaaaaaatgaaaccatggaggaagttcgcacgtctttatagatgtaaggctgtttaaacaagaagaaatggggtatatctaaaagtatgaagacaacgaactcataaggagcaaatcaatgaactggtatgaaaagcttagcgagtactttccaattgaagaaatgaaatcaaaagcgcatatggaagctcttctgaaagagcgaagcgatatttatcataaagatgaaggcaaacatcatattttaatgtttgcggaattcgattcttttatcttcgttgattatctgtatgtgtctaaggatgcaagagggcaggggcttggcggcaaattgatcgcgaagctgaaaaagaaaaataagcccatattgctcgaggtggaacctgtggatgaagatgatactgatacagaaaaacgcctgaggttttatcaaagagagcatttcaagcatgctcagtcaattgggtaccggcgccggtcattggctacgaatgaagtaaacaagatggagattctgtactggtcaccaaaaacagaatcagaagaagaaattcttgaagccatgaaacagacatatgaaaacattcatacttataaagacgagaaatggtacggggaatcgtacgaaaaaacggatgaagtcctgaaactcattgatgaagaaaaacaaaaaaatattttcgatcagttaagctaattgagaattagaacatatcatgaacattaaaaatttgctggattgacacatttttttcttaggatactgttcacacttacttttttatagtataatacctgtaaagattccttttttagagtaatttcaatttaagaataaaatagatgttcatcctactaattagaggagtgaagatgaatggttacactatacacatcaccaagctgtacttcatgcagaaaggcgagagcgtggctcgaggagcacgatattccatttgtagaaagaaatattttctctgaacctttatcaattgatgaaataaaacaaattcttcgaatgactgaggatggtacagatgaaatcatctcaacccgttcaaaagtattccaaaaactgaatgtgaacgttgaatctatgccgctgcaagatttgtaccgcttgatcaacgagcatccagggttgcttcgccgtccgatcatcattgacgaaaaacgtttgcaggtcggatataacgaagacgaaatcagacgtttcctgccaagaaaagttcgctctttccaattaagagaagcacagcgtttggcaaactaatagatcgtatcatcaaaagaaggctgagtcatcagccttcttttttagatagttgacaaaatcctaaaacggttttttgttttaggattttgttaccttttcagttcagcgtgattgaaaacctttgaagtctaggaaggccgagcattggagcacaacgaatatgtttattcgtgagcaccgacgcgcaggtctgacaaggaatgcaaaggtttgtcgacacgctgaaagaaggctgagtcatcagccttcttttatttttcaacctgctggtaataaatgctcgcaaggatgacaaacgcaaccgtcaaaatggggaggagcgtttcaactgtgccgtgctgcgccataaaaagagacagctttttgtctctgacaatcatttctccgccagtataagcaagcagcccgcttcccgcgtaaatcagaagcggtattttctctagtgcaatatggatgagtttgctgccccaaataataaccggaaccgatacacacaaacctataacaacgagagaaaactcaccgtgtgaagctcccgcaactgcgatgacgttgtccagcgacataaagagatctgcaagcacaatcgttcgtatcgctctccacagggaggtgctgcttttaatgtgtttcgtgtcttttttttcaatcagcagctgatatcctaaatacagcaggaaaattccgccggcgcactgcaagaacggaatgttcaaaagatatacagctgcacttgttaatccgattctcatggcaacggcaataaatgttccgagaataatggcttgctgtctttgcttgtccggcaaatgtctgctggccatggcaatgacaaccgcattatctccgccgaggatcaggtcaatcccaacaatgacaagcagagaaatcagatagtcatgctccatgaagcggcacctcgctttcagtccttcgcttgtactactactatatgagacaggtcgtattttatgatatcagccgcctgaactgccgttttttaggcaaaggtgcatttttatttcttttgtgactgttttatcataaaatagaaatacaaaggaattcacactggccttggttaaggttaagatgtggacggaatgggtaaagtgtagtaaagtacaattaatcgggagcttagatgtcccttcaacatcttatatagaagggaaggttggcaaatggaaattgaaagaattaacgagcatacagtaaaattttatatgtcttacggagatattgaagatcgcggttttgacagagaagaaatttggtataaccgtgagcgcagtgaagaactattctgggaagtcatggatgaagttcatgaagaagaggaattcgctgtggaaggcccactttggattcaagttcaggcactggacaaaggattagaaatcatcgtcacaaaagcccagctttccaaagacggacaaaagctcgaactgccgattcctgaggataaaaagcaagaaccagcatctgaggatcttgacgccttgctggatgatttccagaaagaagagcaagccgtcaatcaggaagagaaggagcaaaagcttcaatttgtcttgcgatttggcgattttgaggatgttatttctctatctaaattgaacgttaacggaagcaaaacgactttatattcgtttgagaaccgatattatttatatgtagatttttgcaatatgactgatgaagaggttgaaaatcagctaagcatcctgctggagtacgcaactgaatcctcaatcagcatacaccgtcttgaagagtacggcaagctgattatttcagagcatgctctagaaacgataaaaaaacactttgcatcatagcaaaccgatttccttccggaaatcggttttttttatgcacgaaaatgccattttagagatgtgaaaaatcaaaaacatatagacaagcagaaaatacagcgaacaggagttgatcatcttttccagaaagtatacttcatctggaaaggagagatgacaattgtttagtgctgtgactgaagacggccaactgtttcaccttctaggcgctcagcaaaaccagaaattaaagcggagacggttcttctgtccggtatgcgggggagagctagctgtgaagctcggacttcaaaaagcgccgcattttgcccataaacagaacaagtcctgctccatagacatcgaaccggaaagcgcctaccacttagaaggaaaaagacagctgtatgtatggctgaaaacacaacgggcttcaccaatattggagccgtatataaggacaatcaaccaaagaccggacgtcatggcaaggatcaaggagcatatgcttgctgttgaatatcaatgcgccactatcgctccagatgtctttcaaaagcggacagagggcttcaaacaagaaggaatcatcccgcagtggattatgggatacagccgcttaaaacggactgcttcgtccttttatcagctttcagcttttcattggcagtttatcaatgcaagtccatacagagagctgatatgttattgtcctgaaaggcgttcttttctccggctcagccacatcattccattctacacaaaccattcttattcctcagtccaaacgatccctatccatcgggcaggtgcagacgatctttttttcactgaaccgaaaccctcaattcaatattcaggctggacgaaagcgattcaccgttttcgccataaaccccatcggtttaactcaaaggaaacaaatcgccttaggctgctgttttatgagaagcggcagacgcctttttcttttctgccgactgaagtgtttgttcctgttagaaaaggggcagtttttaagagtccggtttttgtgtggcaggggtttctttatttgtttatgacggatcttggagataaacgtgcgccaattcgtttttcagccgttttgcagcagtgcaaactgcacattcataataagaacattgcactcaggttcgaatgcagcgaagagtgtctttcagaagcggttaaacagtatattgattttttgtgcaagaagggatttttaagggagactcagaaagaagtatatgtactgaatcagcctgaaggcggcatacactcaatgcaggatctcatagaaagagaccgcagctgttttatagaatgagtttgtcttatttggctcaccctaagacaaaggtggtgggcaggctgtgaaaggcacaaaaggaaaggtttttcgtgtttttactgcttttttggcattcgttctcttcattactgcatatgatttgacaaaaggcagtgaaaaaccggaagatattcacaacacaagtttattgagaaacagctgttttttcaattggcttgaatcaaagaagacgagggggatcaccatggctgaggaaaaaaaagcaaaccaactgcctgacagaagtgaggtaaaggcagaagacacatggagacttgaggatatttttcctagtgatgaggcctggaataaagaatttcaagctgtaaaagaattaattccgaatttatctaagtataaaggaaagctggcagattcagctgatcatttatacgaggctcttacgtatcaagataaagtgatggagcggctgggtaggctgtacacatatgcgcatatgcgctctgaccaggatactgggaactccttttaccaggggctgaatgacaaggcgggaaacctgtatacacaggccgcaagcgcgacagcttatttggttccggagattttatccatagaagaagacaaactgcagcagttcattcttgaaaaagaagaattgaagctgtactctcatgcgattgaggagattacaaaggaacgtccgcatgtgctgagcgagaaggaagaagcgctgcttgctgaagcctccgaggtactggggtcatcttcaaatacattcagcgtgttaaataacgcagatattacgtttccgtccattaaagacgaagatgggaatgagaaacagatcactcacggcaactttattaatttcttggaaagtgaaaaccgtgaagtccgcaaaaatgcgtttgacgcagtgtataaaacgtacggacaatataaaaacacaatggccacgacgcttagcggcactgtgaaaaaggacaacttctacgcgagagtgaaaaagtacaagtccgcgcgtgaggctgcgctttctaacaacagtattcctgaggaagtatacgataaccttgttaagacgattaataagcatttgccgctcctgcaccgctatattgcgctaagaaagaaagtgcttgagcttgatgaagtgcatatctatgacctgtatacaccgcttgtgaaagatgctgggatgaaggtgacatacgaggaagccaaagattacatgctgaaaggcctcgcaccattaggggaagaatatgcctctatcctaaaagaaggcctggaaaaccgctgggtggacgtttacgaaaataaaggcaaacgcaatggggcttattcatcaggagcttacggcacgaatccgtatattttgatgaactggcataataacgtgaataatctctttacgctcgtgcacgagtttggacattccgtacacagctactatacgagaaagcaccagccttatccatacggcaattacagcatctttgtcgcggaagttgcctctacgacaaatgaagcgctccttggcgaatatttgctgaacaatttagaggatgaaaaacagcgcttatatattctcaaccatatgcttgagggcttcaggggaacggtcttcagacaaacgatgttcgctgaatttgaacatctgatccatacaaaggcgcaagaaggcgagccgcttacacctgagcttctgacaaatgtctattacgacctgaataaaaagtattttggagacggcatggtgattgataaggaaatcggccttgaatggtcgcgtattccgcacttctattacaattactatgtgtatcagtatgcgacagggtacagcgctgcccaagcattaagcagccagattttgaaggaaggaaagccggcggttgaccgttatattgacttcctgaaagcgggaagctcacaatacccgattgatgtcctgaaaaaagcgggtgttgatatgacgtctccagagccaatcgaagccgcgtgcaaaatgtttgaagaaaaacttgatgaaatggaagagctgctgatgaaagtcaagcagtcttaaaaaagtaagcctgtgcggaaatgacgcacaggcttttttaaaaccctttaaaggttttccggtgattcaagcggtagagggtaaacaaaatagacagaaacagcagaggagaggtaatataaagcggcagcatatgcatcatgcctaagatattcagacagaaaaaaacggcaatgcacacaattgagatcaaagtagacatcatggcgatcctcctcgtcctttttccttataaggatatgagtgaatgcacttcgttatgttttgtgacaaaaatatgaacattaagcatagaggttgtcaaaagtcgacatcttttgttatcataaggatgtgaaattgatcacaaacaaacattacccctttgtttgaccgtgaaaaatttctcccatcccctttgttgtcgttaagacatatgaaaccgcgcttatcccggcgcggtttctttagcgttaaaattagaacgtatgtttggttcagggcgtaaaaaaacagcctcaagcatatgcacgcctgcggctatttttcacatgattgatattcatcagaataagtgctgagagacttccaaaacattccgtgtttggcttccactttggcaacctttttagcaaacgccagttttttcatttctttttctacctcttccaagctcaggtcatatacaagagcaatttccttcgaggcaacgaagcggaaatattcaataaaacattctaaaggcggtgtttccgacggcttcggctcgtcgccaagcatctcaaataaaatttcttcatatacatcatatgagtagctgccaggaactttaagcccttcatcctcatgctgcgtattaaaaaacgtcagtgtcggattaacagaaacatccatctcagcagcaattttcatgtcacattgaagcgccttgaccgcgctttgagaatgcagatcttttttgaattcttcaagatcgagacttgtattttcagcaatctccaaaagcacgttttcatccgtaatatttttctttgaaacaaataggctctcctgcatatttctgagaaattgcatgccggcttttcgtccttgcaattcggctgctttaaaagcgagagcagccatataaggcgatgaaagcggctgttcctgttcgaaccagacattgccgtcacatgacatgccagagcggctcgcgatcttttcccatgcttctgcgagaagatgcttttttcgctttttatttaaagcggtaaggcttgcggaagcgataatgcgtaaggtgaaaaaacgtccgtatctgattttcagctttttgatgacgggctctaaggaccagcattcaggacataaagggtctacaaacatataaatttcaagcggtttttttggatgaccgtggcaatgggcgaagtatagctcatgctgatagtttgtcaagatgatcgatcctccgcttccgtttgattcaccatatgccttgctgtcaactccagccggccaaacaaaaactcacgaatttcgccctccagccctacatggtccattgcgtccttcatacagctgagccacgcatcagctctctcgtttgtaattggaaagggaagatgccttgctctgagcataggatggccgtgttcctcagtataaagaggaggcccgcctaaatactgagttaagaattgcttctgtttcctggcggtttctgtcaaatcgcttggaaaaatcggcttcagcaaaggatgagacgcgacacgctcataaaaagtatcaacaagttgcgatagaagttcctctccaatcgcttcataaggtgcgttaaacgattgtcccatgttgactactcctttaaatatggctaataggaatcataaatcctattgcaaaaagtaattttctgtatttcattgtttcatctaggtttattttagcaacaaggcatcatttctacaaacaaactgccttttttgcgtatgatgactcatttcggctgacagccggggtttgtatttcatatcatatcacataaaaatcaggaatgcgtaagatttcacttcgcaaaaaaaccagaggggaagccctctggttacgcgtaataagctgaagttattttttttacatagttttgcgtttcttgaaaaggaggaatgcctccgtatcggtcaacattccccggtccggcgttgtaagccgctaatgccatagacacattgccgtcgtatttatccagcatttgttttaaatatttcgttccgccttccacattttgttgtggatcaagcggattggaaacgccaagtgagcttgctgttgacggcatcagctgcatgaggcccatcgcacctgctccgctgaccgcttttgcattaaagcctgattcttgtttgatgacggcacggatcagtttttcatcaacgccatatttatcagcggcttttttaatcgcactgtcaatagagaagttacccgaactaatctgatttgcttcgtgtttgtttgaagctgaatctgcagcagctgttttagtgctttctgccgcttttgtgattgaacctgaattgctgctcgtatatgagttaagcccatacgctgaaagcagtgacggcgctgttgtattcgcgttgttcagcatgctgagcgggcttggcgatgaagaaggtgctgattgctgagatgccagaccgtttgtatattggctgagcaaagaactgaaacttgaaagcgggctttccgtattctgagtgtccgagctgctgcgtgcattagatatggactgtaatgcctgaagctgaagtaatgctgcccaattcgttacattcacgatgtcattccaccttatatagactttcgtttttcttcataaaaacgcagaattttatttttggtttcgcgctgaggaatgctgaattgctgaagcagcttttcgaaggcttgtctgccctcatgccaatccgccgcctcaaattcaatttcatagtcctctttatttaaatatcggctgtggtctaaaactattaagcctttttctgtttctttttccgcacggtttgttgctaaagatccaaagtattgaatggcatccgtatcgatctgaagcttgtgcagctggtccttcacagggccctcgggaactgaaaatccagcgagatctgatacctctgaaagctgctggtgcgtttccagaagccccacatcagccggctcctttaatgtaaggacatactttccgttttttctgcggatacgaagcgcagcatgtttttgtttcagcgcgaagctgtctgtatcaaaataatgattcttttgatctgtaaaatctttttctgtcagctggagtgccgctgctatgtttttgaattcttgtttggtcagcatgtttttaaattcgatttcaatttcttggctcatgatgctcttcctttccgccctgtaaatcttatttttactattatctctttagatgttaggtttatcaatatcgagctcgatatgataaaatgaatctgtactttgtttaaaaaaggagagcattatgcaaaacagaatcgaaattttgaatgcaacattatcggatgatcagcttcgccttgcctgtcagacagaaggaaacgaagcggaacgcaagccgtcaggtcaaatgcttgttgattctgaccactttgcttttgtatacatacttgaattagctgattcttttgaatatgtcattataaaggaacatgtatggccggaactgaagcaggcccatgcacaaaaaataccggttgttttagaggcaggaaaccaaacaattgaactggcaggcctgcatgaggagctggaatatcttttagaaaatataaaagataatgcaaactatggagaagaaatggaagaaaaagtgaaacgcgtgtttttatagaaactggttcggaattgggggatgtatgatggatgacaaacaatgggagcgttttttagtgccgtaccgccaggctgtcgaagagttgaaagtgaagctcaaggggatccgcacactatatgaatacgaggacgaccattcaccgatcgaatttgtgaccggacgcgtcaagcctgtggcgagcatacttgaaaaagcgagacggaaaagcataccgctgcatgaaattgaaaccatgcaggacattgctggccttagaatcatgtgccaatttgtcgatgacatccaaatcgtaaaagagatgctttttgccagaaaagatttcaccgttgtggatcagagggattatattgcggaacataaagagagcggataccggtcataccatctagttgtgctgtaccctttgcagacggtatccggagaaaagcatgttctcgtggaaatacagatccgtacactggcgatgaatttttgggcgaccattgaacattcattgaattataaatacagcggaaacattcctgaaaaagtaaaactaaggcttcagcgcgcttctgaagcggcttcccggcttgatgaagagatgtcggagatcaggggtgaagtacaggaagctcaagctgccttttcaagaaagaaaaaaggaagcgagcaacaataggtaaagggggagaagagcatgaaatttgccgtatcatcaaaaggagatcaagtttctgatacgctgaaaagcaaaatacaggcgtatttattggattttgatatggaactggatgaaaatgaaccggaaatcgttatttcagtcggaggcgacggaacgcttttgtatgcttttcacagatacagcgaccgcttggacaaaacagcatttgtcggcgttcacacaggtcatctgggtttttatgccgactgggttcctcatgaaattgaaaaacttgttcttgccatcgcgaaaacgccgtatcatacagtcgaatatccgcttctcgaagtcattgtgacctatcacgaaaacgagcgggaagaaagatacttagctttgaatgaatgtacgattaaaagcatcgaaggaagccttgttgctgatgtggaaatcaaagggcagctctttgaaaccttccggggcgacggcctctgcctgtcaactccatcaggcagcacagcctacaataaggcgctgggcggagcgattatccatccgtctatcagggcgatccagcttgcggaaatggcttctattaataaccgcgtgttccgtacggtcgggtcacctctgcttctcccatcccatcatgattgcatgattaagccgagaaacgaagttgactttcaagtgacgattgaccatttaacccttctccataaagatgtaaagtcgatccgctgccaggttgcatccgaaaaagtgcggtttgcgagattccgtccgtttccattttggaaaagagtccaggattcgtttattggaaaaggtgaatagaaagaggacatatcgtggagcatttttttatcagaaagaacattacttccgctgaggacgggatgactgtaaaagaatatgccggtgaactgggaatttcgaaacgtctgctgaccgatattaagtttggcgggggcgacctgcagattaacggtgagcatgtgacggtcaaatacgttttgaaagagggagatcttcttatcgtgaagtttcctgaggagcaggtgagcgagacgctgttggcagagcctgttccgctcgatatcctttatgaggatgaacatgtgcttgtgataaacaagcagccgtatgtgtcatcaatcccttcgagagagcacccctccggcagcattgctaatggaattattgatcattatcaaacaaccggagtgagggcgacagttcatcttgtcacccggttagaccgggatacatcaggtgtcatgcttgttgccaagcatcgatttgcccactccattttatcgtctgcgcaaaaaaacggccttgtgaaacgccggtatgcggcagtggttcacgggcggatggcacagatggagggaacagtcgatgctccgattggcagacatcctgacagtataattgaacggacggtaacgccagacggccagaaggctgttacgcatttttacgtcacatgtgcaaatgacgatatgacctcggtgacgttgcagcttgagactggacgaacccatcaaattcgtgttcatatgagttatctcgggcacccgttgtgcggcgatacactgtacggcggaacgagacaggaaattggccggcaggctctgcacagcgagcatctttcgtttatccatccgctgacacaggagaacatgacgtttcatgctccactgcctcaggatatgagaaaactgataaaaggagagaatcattgattctctccttttttatatggggcgaaatcttgattcgtcgtaaggcagggagcttggaacagagacggtttctatttctggaaagcgaaagcctgtcagttgatttccgaacacgcagcctgtatcaatgttgatggtgcgattgaccttccgaggctctttcacaggtgtatgaccgtataccacccaagcctttccgttataggctgccgcccaatcacgtctgacgggtctgccgtccggatatgtttcacccgtcacgtcaccgtaaagcacaaagtccttcactctccgggtatatttgccgatatcgtcagctcttatgccagcatgggcgacaactaattctccattatgtaagatgtcgtaaagcggcgctgtttcgtacagcttcataaactgttcgctgactgattttctctcatctttagaaagttcctcaagctctgccgctgttgtttcgagaccatgcatcacttttaccggatttccttttaagtaacgatataatttattgcaatggtttcccgggacataacgcacagcgcctttttcgtaagcgccggctacaaatcggatgacctctatcgatttgggccctctgtcagttaaatctccggcaaaaacaagcaccctgccttcttcatggacaggtactccatttttgattgtatagccaagcttttggattaatgcagtcatttcgtcatagcagccatgaatatcgctgatgatatcgtaagccatgcggtatcctccttaccgattgttttatttattatgaagcaaagtgttgtgagtcatcacaagcttttatgtgcaaattatagaagaagaatcattttctaaacaggattaagaccttatcactttatttttcatcatcacccttgttaaaatcgcgttatgttttttaaaaatgaggttttgttctctgagtgagaactagcataaccctgacttaaaaaggaggttctgattatggcgcatacatctgtcgcatcattagttgttgtacttatcgttgcatttttgacacccatccttttgcatcggtttaaactcagcatcccggttgttgttgctgaaatcattatggggctgattattgggaaaagcggccttaatttagttgtggagggtgacacctggctccaaacactctctatgctcggatttatctttttgatgtttttaagcgggcttgaaattgatttttcgtcgtttgagaaaggaaagaaaaagcagttcctgccgaatggcaaggaagcgccgaatacgtttgctgcggcatctgttattttcgtcggtatttttattttatcattgctcttgtcctatgggttcgtcttggccggatttatccaaaatgcatttttgatgaccctgattatttcaacgatttcattaggcgttgtcgttccaacattaaaagaagaacggatcatgaattcgaatatcgggcagattattttgcttgttgctgttattgctgatttggccacgatgattcttcttgctgttttttcttctttatacggagaggacagcggaaacatgtggctcctgatgattctgtttgcagccggagtggtgctttactttttcggccgggtctttaaacatcgctcttttgtgcagtccatgtcaaaagggacgatccagatcgggacgcgtgccatttttacgttaattattgtactcgttgccctgtctgaatcacttggggcggaaaatattctcggcgctttcttagcgggggttctcgtttccctgctttcgccaaacaaagaacttgttcagcagctggattcatttggttatgggttcttaataccgattttcttcgtgatggtcggtgtgaagctggatatttggactcttttccaggataaaacaattttaatcatgattccgctcctgctgctggcgctgttagtcagcaaaatcattcctgtcatgtacctaaagaagtggtatgataaccgaaccattttcgcgtctggcttcttgctgacatctacgctttcgctcgtgattgccgctgcaacaatcggccagcagcttcacgtgatcagcgcaaatatgtcaggagcgctcattttagtagccgtcattgcaagtatttttacgccgatctgttttaaaaaattatacaaacgggaagagcagccggaggagaaaaagacgattacgttcattggcgccaatcaaatgactttgcctgttacactcgaattgccagaggaagagtatgacgtgcgtgttgtacacgtctatcaagagaatgcggaggaaaagctgtcagaatcagtgtttgctgttgaaacaatttctgactatgaacacgagacgcttgaatcactcggcatttttgaaacggatatcctcgttgtggcgacaggaaatgaagatatgaatgcagacattgctttacttgcaaaagaaaaaggcacagaaagagtcattgcaagcgtaggatcaccggagcatgaagcagttctgaaggagcagggaatcagcatcttttctattctgctgtcgacaaaaacgctgcttcgcgcactgattgaagcccctggcgtcatgaagctgctcacgaaccaggagtcttcgctgtatcaaattaatatggagaacagtaaatacgacggtgtgattttacgggaattccctttaacaggtgacgtcatctttgtcaggatcttcagaggtgtggacagcatcgttcctcatggggatacaaggctgaaacttggagaccgtttaattgtcaccggatctcgggatacgtaacggatcttaagaaaacattggaaggataaatcttgaccaaataaggattcgtgttaatatagaggtgcagaacaattcaatatgtattcgtttaaccactaggggtgtccttcataagggctgagataaaagtgtgacttttagaccctcataacttgaacaggttcagacctgcgtagggaagtggagcggtatttgtgttattttactatgccaattccaaaccacttttccttgcgggaaagtggtttttttattttcagagggggaatgatttgtgaagttttcagaagaatgccgcagcgcagccgcagaatggtgggaggggagctttgtccatccgttcgttcaaggaatcggtgacggaacgcttccgattgaccgttttaaatactacgtacttcaagattcctattatttaacgcattttgcaaaggtgcagtcatttggcgcagcttatgcgaaggacctttttacaacggggcggatggcaagccatgcccaaggtacatatgaggcggaaatggcgcttcatcgcgagtttgccgagctgttggaaatcagcgaggaagagcgtaaggcgtttaagccgtctcctacagcgtactcttatacatcccatatgtaccgttcggttttgagcgggaatttcgcagaaatcttagcggccctgctgccatgctactggctttattacgaggttggtgagaaattgctgcattgcgatcctgggcatccgatttatcaaaagtggattgggacgtacggcggtgactggtttagacaacaggtcgaggagcaaatcaaccgctttgatgagctggcggaaaacagcacggaggaagtacgtgccaagatgaaagagaattttgtcatctccagctactatgaatatcaattttggggaatggcctatcgaaaagaaggctggtctgacagcgccataaaagaggtggaggaatgtggagcttcacgccataacggatgacagcaagccggtagaagagctagcgagaatcatcattacgattcagaatgaagttgattttattcatattcgggaacgttcaaaatcggcggcggatattttgaaactgctcgagcttatttttgaaggcggtatagataaacgaaaactggtgatgaacgggcgcgtggatattgcgcttttctctactattcaccgcgtgcagctgccaagcggcagcttttcaccgaagcaggtcagagccagatttccacaccttcatatcgggagatcggtgcattcactggaggaagcggttcaagcagaaaaggaagacgcggactacgtgctgttcggccatgtgtttgaaacggattgcaaaaagggtcttgaaggcagaggagtatctttgctgtcagatatcaaacagcggatttccatcccggttatagccatcgggggatgacgccggacaggttaagagacgtaaaacaagcaggggcagacggcattgctgttatgtcaggaattttctcttccgctgaacctttggaagcagccagacgatattcccgcaagctaaaggagatgcgctatgaaaaggcattatgaagcagtggtgattggaggcggaattatcggttccgcaattgcttattatttggcaaaggaaaacaaaaacaccgcattgtttgaaagcggaacaatgggcggcagaacgacaagtgccgctgccggaatgctgggcgcccatgccgaatgcgaggaacgtgacgcgttttttgatttcgccatgcacagccagcgtctgtacaaaggtcttggagaagagctttatgcattatccggtgtggatatcaggcagcataacggcggtatgtttaagcttgcattttctgaagaagatgtgctgcagctgagacagatggacgatttggactctgtcagctggtattcaaaagaagaggtgttagaaaaagagccgtatgcgtctggtgacatctttggtgcatcttttattcaggatgatgtgcatgtggagccttattttgtttgcaaggcatatgtgaaagcagcaaaaatgcttggggcggagatttttgagcatacgcccgtcctgcatgtcgaacgtgacggtgaagccctgtccatcaagacccctagcggagacgtatgggctaatcatgttgtcgttgccagcggggtgtggagcggaatgttttttaaacagcttggactgaacaatgcttttctccctgtaaaaggggagtgcctgtccgtttggaatgatgatatcccgctgacaaaaacgctttaccatgatcactgctatatcgtaccgagaaaaagcggcaaactggttgtcggcgcgacaatgaagccgggggactggagtgaaacaccggatcttggcggattggaatccgttatgaaaaaagcaaaaacgatgctgccggctatacagaatatgaaggtggatcgtttttgggcgggactccgtccgggaacaaaggatggaaaaccgtacatcggcagacatcctgaggacagccgtattttatttgcggctggccatttcagaaatgggatcctgcttgctcccgcaacgggcgctttgatcagtgatctcatcatgaataaagaggtcaaccaagactggctgcacgcattccgaattgatcgcaaggaggcggttcagatatgatgctacagctgaacggtaaagacgtgaagtgggaaaaagacacaggtacaattcaagacctgctggcgtcgtatcagcttgaaaataaaatcgttatcgtggaaagaaataaagaaataatcgggaaagaacgctatcacgaggttgagctttgtgatcgtgatgtcattgaaattgtccattttgtaggaggcggatgagcatgttaacaattggcggaaaatcatttcaatcaagattgctgctgggcacggggaaatacccatcgtttgacattcaaaaggaagcagtagctgtttctgagtctgatattttaacatttgctgtaaggagaatgaacatctttgaagcatctcagccaaattttctggaacagcttgatttatccaaatatacgcttttgccgaatacagcgggcgccagcactgctgaagaagcggttcggattgcaaggctggcgaaagcgtcaggcctttgtgacatgattaaagttgaagtcatcggatgcagccgttccttgctgcctgaccctgttgagacattaaaagcgtctgaacagcttcttgaagaaggctttattgtgctcccgtacacgtcggatgacgttgtgctggcgagaaagctggaagagctcggcgttcatgccatcatgccgggtgcatctccgattggatcaggacaaggaatcttaaatcctttgaatctgtcgtttattattgaacaggcgaaagtgccggtcatcgtggatgctggaatcggctcgcctaaagatgcggcatacgcaatggagcttggagcagatggcgtactgctcaatacggctgtatcgggagctgacgatcctgtgaaaatggctcgtgccatgaagctcgcggtggaagcaggacgcctttcttatgaggcgggccgaatcccgcttaagcaatacggaacggcaagcagtccgggagaaggtcttcctgtatgacgggcaggtattcaaggcaggagctgtttgctccgatcggcccatccggccagaaaaaattgaaagaagcgcgcgccgtgattatcggcgccggcgcgctcggaacagccagtgcagaaatgctggtgagagcgggagtcggctctctgaaaattgccgacagagattatgttgaatggagcaacctccagcgccagcagctttatacagaagatgatgtcaaaaaagaaatgccgaaagcagccgctgcggagcgccgtctccgttcgattaacagcgatgttgatgtgaccggccttgtcatggatgtgacagcagaaaatatcttcgagctgattagggatgcatcgattattgtggatgcggctgataattttgaaacccgcctgatcgtaaatgatgctgcggtaaaggaagagattccttttctttacggtgcctgtgtagggagctacggcctcacctttaccgtggtgccgggttctactccttgcctgcattgcttgctcgatacacttccgattggcggagcaacatgtgacacagccggcatcatcagtccggctgttttgcaggtagcagtctttcaggtaacagatgcactgaagctgctgacgggagaggagtgcgagccgatgctgcgctcctttgatttatggaaaaatgagcggtcagaagtgagagcagccagtctcaaacatgacgcatgcccaagctgcggcacaaaggattttccgtttttgtcatatgaaaatcaaacaaaagcggctgtattgtgcggcaggaacacggtgcagatcagatcatctattacgaaagaagcggatcttgaagcgcttgccgctcagctgaggcaggccgggcttgaagtagctgcgaacccgtatttaatttcctgccgctcggatgatatgaaaatggtgttgttccgggacggcagagctttgatccatggaacaaatgatattgcccgggcaaaatccatttatcataaatggattgggtaataaaaggagtgtagtgtaatgagtatatataaagcattgacaatcgccggatcagattcaggcggcggcgcagggatacaggctgatattaaaacctttcaagagcttgatgtattcggaatgtctgcgattacggcggtaaccgctcaaaatacgcttggcgttcatggggtgcatccgctgactgtagagacgttgagacagcaaattgacgctgttgctgaggatttgagaccggatgcagttaagacgggaatgctctggaatgccgacatgattgaagaagtggcaagaaaaattgacgagtacggattcaatcgtgtaattgttgatccggttatgatcgcaaagggcggggcatccttgctgcgtgatgagtcagttgccaccttaaaggagttgctcattccaagaagctacgcgattacgccgaatgtcccggaagcagaaacgctgacaggaatgacaatcagctcgctggatgaccggaaaaaagcagcagagcagctcgtcaagatgggtgcgcagcatgtcattatcaaaggcgggcaccagcctgaggacaatcacattactgaccttctttttgatggcagcatgtttatgcaaatcacccatccttatatcaatacgaagcatacgcatggcacaggctgcacctttgctgcggctttaacggcccaaacggctaaaggagacagcatccatcaggcatttgaggttgcggccaactttgtccgtgaagcggtggaaaatacgctcggcatcggatcgggacacgggccgacaaaccatttcgcttttaaacgaaacagcttaaatacaagccgatgagatcaccagctgatggtgatctcttttgcgtttgctacggtatgcgcttttcatctggacaaggttatgatatgataggaattaagatcaggtactaatactatgtctttattaaatataggaggctttatacatatgaatttttcacttgaaggccgcaacattgttgtgatgggggtagccaacaaacgcagcatcgcctggggcattgcgcgttctttacatgaagcgggtgcacgtttgattttcacatacgctggtgaacgcctggagaaatccgttcacgagcttgccggaacattagaccgcaacgattccatcatcctcccttgcgatgttacaaacgacgcagaaatcgaaacttgcttcgcaagcattaaggagcaggtcggtgtaatccacggtatcgcgcattgtatcgcgtttgccaacaaagaagagcttgtcggcgaatacttaaacacaaatcgtgacggcttccttttggctcataacatcagctcatattctctgactgctgttgtcaaagcggcacgtccgatgatgactgaaggcggaagcattgtcactttgacgtaccttggcggagagcttgtgatgccaaactacaacgtcatgggtgtagcaaaagcttctcttgatgcaagtgtgaaatatttagctgctgacttaggaaaagaaaatatccgcgtcaacagcatttctgccggcccgatcagaacattatctgctaaaggcatcagcgatttcaactctatcttaaaagacatcgaagagcgtgcaccgcttcgccgcacgacaacacctgaagaagtgggcgatacagctgcgttcttgttcagcgatatgtcccgcgggattacaggtgaaaatcttcacgttgattcaggtttccatatcactgcccgctaagcaggatctatatcaagcaatcccgaatagggattgcttttttatttcttctgattttcagctttctgtcatatagatagaatatgacacaatcggagggatgaagatgtctaataagaaaagaaacgcggataaaaaaccgctcatgtatattgttcagccggattatgcagaaactacaaggtcatccatgcaggagattgtcatcaaaagaaaggccgacaaacccgctccgccaaaagctgaggaaaagccggcttaccatgagaagcagcaggaggaagccgtggcacaggatgtcctgcaagaagaccaaaagcctgcagccgaaccagtgagtcagcaaatacaagaggtgagagagccagagaacataaaaagccaagaggaacagaaagcagagccgcaggccgtagaagaaaccgttgaacacgagcccccgaaagcagaaaaaaaggaagagcctgcacttgaggcccggaagcctgagaaagaaccggaagctgtccatagtgccgataaagcggaggaaaaagcacctccggcacgaaaagtgaaaaaaccgatgagcaagatgacgatccacgaaaaaattgattttttaacaaagctgcctcataacatgccgagagcgctttgtttgattgaagccaatggaagaacgtacaggggcgtaattgtcggaagaagaaatgattccgtcctgcttcgaacaacaggaaacggagccccaaccgaactggcaatcgatgatattacctctttgcacccgctcggtttttaacgaaaaagaaaaaagctgcccggctgatgttgccggacagcttttttacatagagaaaagcctgcaggcctgcaagcttttccagcttatgattaatgatgatgtgtacgattgattaatcgaggatttaagcagttgattgcgcagaagcagtctaagtcaacttcaatacagtagttcgttttttcgagtcggaacacttcacacaccgtatctttatcggtgaagtccaaaatgtgtttgtgttcgtcaaatgcgattaataatgacagtgttgcgcagcttccatgcactctttcaaccctgaaaaatactgtattaaagcaagggccgttatcgagttcgccgacatttccgaaggcgactaatggcgttgattttgatgtaaatattgcaaaaggcactgtgtcgcctaacgaatggcttacagataaaagcttagagtggcagccggtcgggcagtcttcttcaacagcgttttgcagatcttcaatattttctacagcttcacgcacgcagcttgatgttttctggctcatattatccctcctgccttataaatttgagactggcgaaatgatggagagtcagctgcctcacgctggaagcagctgaatgatttgcacctgtaatagagtttggaaggggattcctctttacaagtgtttatccattgtgatgatgctttttatctttatgaggcgatgttctgtcaactagctctggtgacaggcactgaatcgcgcagaagcatccgagatcgacttcaatgcagaaatctgttttttctagcccgaagaaatccgggtcgcaagggtggcaaacacttaaggtatcgcctttgacatcgaccgggcgtaaaatagaaagtgttgcacagcaatcgcataatttttcgacgcggaagaaaatggattcaaagcattgcatatcatccacaaatccccctacgtttccgaatgtggagaacaatccgccttttttatcaaaaacgagaaacggaattgtgtcttttccagcaatcgtagggtttaaaaggttggtatagcagccagtcggacactgttcttcaactgcctcctgctctgctaaaatcttttccactgcatcgcatacacagttctcatgccggccatgggtttttccgcagctcattgatttcagctccttctttatagggtatttgactttagtccttaacaacatatgtacccgtgccccacttggtgtgggtgaacgtctatatattcatcatatgcttggaaaataagaaaaagcagagcgtttttagctctgcttttaggttctagaggacaagagtgataactaggatggctacgagtgtatttgttgctgtagagataagggttgcgatatcggcatctactgttgtgacgtttacgccgcgggaacattcgatgagaagtttttggcgatttacttgtttgttggctgtaagctgtaacaaatcttgtgcgactaattcggcaattacgccgtctgcaattgatgtcagagttgccgttacgacagcggcattaagtgctgttacaactgatgttacggcttgaacgtctgtagatgtaacattgatgtcacaagaatctctaataataatcgtttcatctgatacttgtttgttgagatttgcttgagctagatcttggtcgatgaaggcgttgtcgttgccaaaaaaaccattgccattacagcaaacgtcgcaatgacattttctttcgtgtttttctttatctttctctttgtcatctaacggatggtcacagtcaggatcaagtgcaacccaagaatatggtctgctttccatatctattcctccttttcttttactgttattaaatgagcgagcctcttattttgactgagtcatatatcctgatgaagaaccctatttttttttatgattggctaattgttatcgtttttccgtctttgtctgatctgttcaatgagctgctctctgcggcttagcggttttgtgttttgctcttgcacggctgcttcttcttttttcttcttttggttttctattagcgcttgtgatttagcttgtaagtcttttacaagatttaagagcatttctttttcttcgtctgatacttttttcattttgtctttcgtgacaccatgtttagaaaatatattttggaccagcattttcgtcattggatcaacttctggaagctttgcaagctcttctttgaatttatcgttatctgacatttgttttcacctcgtcttttaagtttgtgaaaaagaaagggttaaaggacgtcaagttcactaagaatgctgtttaacacctgaagcaagatttgtacaaaggttattatctcgtcggcagacaaagtaattttgatgttgcggctgttgataattttaatgatggttctttttttgatttgtgagctatcgagaataagaatttcacttgccactgcgtcagccaaatcctcgtcggcgatgacgagctgagtcgccacgataatcatggttgtcacaaaggcttgtatagaaagggcagctgttatatgtgacgtgtcaattgtgatattttcgcaatcaatcacttcgatctgctgttcgaattcgcttgataattgctcaaatattgcagggtgcagggattcgactttttcttcaaatgacataaccttcactcctttcttatccatactctatataatgcaaatggggtgcagagcggaataataaaaataaccaattttctgccggacaagatacaattcatgaagaatagggttttcgcatatatgtgaagggatcatgattggcaaaggagtgaacgagtggttataaatgggctgacaatagttcttctatcgcttgcggtctttcggctcgcccgcctgcttgtgtttgacacgattatggcgccgcttcgcagtctgtttcatgaagagaaggaagaaaaggatgcggacgggaatattcaaacctatatcgtgattaaaggaaccggtgtcagggcgtttattggtgaattgctgagctgctattggtgcacaggcgtgtggtgcgccggctttttgattttatgccaggcgttgatcccgcaagcggcgcagtggctgattttacttttggcgatcgccggccttgccggcatcatagaaacgctcgtatcaaaatggctgcaagaataaggcgttaccaccagcaactttctgtcagaatacgcataaagtagcatatatgacataaggaaaggaaggggacaaaaatgaatcaacataataaaccttcccaaaaatctccatatacagattcatcgtatcaatcaaaaaagataaaaaagaaaggctgcgggtgcggaaataaaaagaaaaagcctcaatagcctggcaaagaaaccggagaactccggttttttgtttttttaacggggcggcctcgctcagcatatatcataagcggggggataaaagtgaatgagtttgaaaaatggatagaaggaagatatgaaccacacgaacaaaagcaaaaagagtatgaagacacgatgggccgtatcagaaaagacttggatgcatttgataaagccggtctggaatttgaagatgagattgaagagctggctgaaaaaacggaggccttacttaaaaaacatcaagctcaatatgatcaatcgtaaatccgcaaacgccctatgcgaatatccaagccgatccaagcagctcacatagtgtatagagagtaaaggaggtgcttatctatgggctttggatacggattcggcggcggctacggcggcggctgttatggcggttatgctggcggttacggcggcggctatggttcaacatttgttttgttggtcgtattattcattctcctcatcatcgtaggtgcatctttcttttaagatgtattgaggaagtacgggttataacccgtgcttccttgccttgtgtttatttttaaaaatgttggaaaagcacattgtattatgtgcattcatacaataccgtattactccgccaaaaggaggcgcattatggataatcaattttttaagaacatcgaaaagaaaacaggtgtgaagatgcaggatgtaatgaatcttgccggatcactccaaaacgctaattttaaagatgaaaatacagtgcgcagtgtgattaaccgcgtagcgcagatggcaaacagacgcgtgccaaaagaattagaagataaaattgtggaatctattacaagcggaaaagaaaagcttgattttggcacgatttctaaaatgatggataataaataagtggatggcctggctgactcactgcagcgggcctttttttacagtaaaaacccggcagtaatctgccgggctgttaatgatgcaagggctgtcttgctttctgtagcaggggatacaaaaatcttgagcggttggctgttttgccgcgcctgttagcggggcaagacaaatataaatgctgtttcgcccgggtcatggctacatataaaaggcgtctttcctcctcaagagcggcttcgtctccttttcttgccgtttctaatgagaaatcgtgcggaatcgagccgtctacagtgcctaacacgtagactgttttgaattcaaggccttttgaccggtgaatggtcatcagctgaacgccatgttcatccgttctgtttttctcagcggccctcatatggtctacgtgggcaagaaagtcaggaatcgttttgaacttcttggcgacaaccttgatgtcgcgcaggtcatcggaacctttttccagcttgttgccctcattgccccgcttttttaaatactcggagaagcccatttttccttctgcaaaggtgatggcttctacgggtttcattgtgcggaggcttgcgaaaaacggtacgattttcttgattttgtccagctggaatggcttcagatcaggcaatttggccagcgctttgatcatggtacagtcctctgtaatcgagagcgccttcagcgtattcaaagcggactgttttaaaaacaaggcgggaagcaagtgtttaatcgcctcggtgtcatcctcattttggctggcatacaagtaggcgagaatctggcggacgatccgtctgctataaaacgattggacgccgcggtcagctgtatacggaattgatgattgatgaagcctttcataaatagcacggcctccgctgtttgtgcggtaaagaaccgcaaagtcatctggactggctccattttgaattttttctttgatatcggaaacgaccattgtggcttcttcctcttcatcataaggataaaacagcacagggacctgaatgtcatcgcgggccgcttcaagcgttttggcatatctgtttttgttctttttcacgacgatatcagcactagagacgatcgggtgcgtagacctgtagttcgcagttaaatagatcgtcttcgctcccggataatccttttgaaaatcaagaatgaaagacggattgcttccgcgaaacgcgtagatggactggtcatcgtctccgacacagcacaggttttgctccgggctggcgagcatttgcatgattttgtattgaaccgggttaatgtcctgaaactcatcaattaagatatacgtaaaccgagattgatattgttccagaaggtcaggccgctcgataaacaattcatagcaggctgaagccatgtcatcaaaatcaaattggctgtgttcttttttctggcgttcataatgttcatataaacgataaacttgtttttcccactcatcttttagagggatgcgttcatttgggacataagtgtttttccaaaaaccgatctgctgcagggcttggtcaactgggaattctttctcatcgatgccctcttcatagagtgcttttttgatatattgttcccgctgccactccattttcagcagatgctcaccgttccatttagcagaattagagtgatacaagatcttataaaacagactgtggaatgttcctgtcacaagtcttctgacttttgccggctgtaatccgtactggttggccatacgctctttcatttcagcgacagcttttgttgtaaaggtgacaagcagcatattttcaggcggtatgcctaagtgttcgatcatgtgggcggcacgggctgtcagcacccgtgtttttccgctccccgcacctgcaagcacaagcagcgggccctctgtttccgtgacagctttcagctgatccgtgtttaaaccgacagacggaaaaaggctcgtatcgggttttattgtttttggcacaaatggtgttcctggtttaatgcttctaggacggtgccattccgtaacagctggggacgggtcagcggcgatcgcttttcccttgggtaaacgaatgacaccagattcctgatcgtcttcttttttttcctctttagagggcttcggttcgcacgcctcctcacatgccggaaaatcgcctggctggcgatggataaactctggcggatcggcgatgttaagccgtaacaaaacgggctttccgcaatgagaacaaaataaatgtccttttattccctcttcaaagaggaattgataatgttctctcgaatatgtatgtaaatgtatgattctatcattcagtcgggcgcatttcaaaaaggggtcctcccaatcaaaaggtgttcattacagacaatgactatcatatcaaaagaaatgtgtttcaaaaagtaagtttaagggaaaagagacagcagaggggtgggtattgtatgatatatgcaggtcaaattcagaaccagcaatacgctcaatatgctaatagaacgattggacataagcaggattatgccggaaccgaaaaaatcagctatgtcccgtttcagcgggtatacaaagaactggaaaagcagcaggagaatcaaacggccgctgaaagaaaagtaaacgagatgaaacgtaagcgctctctttataagaggttgcgagaaaaaggaatgggcacatatattaatcgatatgtataaaaaaccgttcataccagagaacggttttttatatgcgaaaaaaatccggatctcaaaagatccggatgcgttcagtccttcatcatttgtaagtgcggaatgccggcatcgaggaattctttttcagaaagcatgcgatacccgtgtttcttgtaaaacggcacagcctgtgtttgcgcgtttaaaatgaaaccggaagcgcctccgtctgccgcggctttttcgagcgctttcataatgatgccgccgacaccggctgagcggtggcttttcagtacgcaaatccgctctaacttgccgtagccgtccttcatgcgccatcttccggcaccgacaggcttttcaccgtcatacacgacgatatgctctgactcattttcaagttcgtcaatttcttcttcagcaggcacgttttgttctttgacaaagacttcttctcttacatagaatgcatctttcaattgttcttcattttttgcgataactgctttcaaacattattctcctctgcctagcaagaaggtttcatatactgtccacgatccgttttccagctggtaaagcaagtggaaacggtcaacgatttcttcatgcgacacttcctgcatttttaattgtcccagcacatctgaatgctcatcgtcggaaagattttggccgaccgtcacatgcggaacgaaattatattcctgttctcctgccaacacaccggtgtatagcttttcattgagtgtttttaactcttccgtcggttctgctttgatgtaaatgacattattgacaggcgcaaatgagctgtattttgtcattttgagaacgagtgggtgggactcttttgcgatgtttcttaaatgtgatacgagctgatccgctttctcctccgcgcattcaaaggatgctctcagcgtcaaatggggcgggatcagagagtagcttgggtcatagcgctttctgtaagagtttgcaaggtcttggagcttttttgatggaaataaaacgattccgtatttcatattatgtccctcctggaaataaagtatgatagagtgttaaagcatttttttcagcgccggggtgatgagcggctgccagtatgtccatttgtggtctccgtcaaatggctcaaaataataatcggaaagcttcttctccagcagctgtttcagctcctggttcggttctgtaaagtccagaatgttcccgtctgtcgtgtggacgtcagtttcttttgttccaatttggtgataaatagagaggtgtttgatatcatctgactgattcacggcttctagtatatgtttgtcaacatagggagactgcatgatgatgttgccaaacatattcggataatcaagcgctgtcataagtgatacggtcgctccgagcgaatcaccgatcagggttcggccataaccgatctgataggttggatactcatcatctgcaaaaggaacgagctcatgggcgatgaaccgtttatacgccgaaaattttgaaccctccggatgataggtgtttctgcgctcttttacatccttatagggaacaccgataataatgcaccggtctatttcgtgtttcgacagcaattcctcaacctgtctgccgattctccccagcctgaaataatcgtggccgtcctgcgcgataatgacatggtatttataaagcggggagtagttggacggcagataaacaagcaaggtcatttcctcgttaagctcttttgaaaagaatttcttttcttgcactgtgccgtttttcggtgccataaaaacattcctccaggacatcactatactttcttgcattttcaattattgtaccatgaattattagaaatttctctctttaaacggttcggaacacgaagaaaaaagtgttgaaataaactgtgaattgcgctaatataaaacaatcagaaaattgaaatcgatatttcttatcgtgagaggtggagggactggcccttagaaacctcagcaaccggcttgttttgcatgtgcaaagcgccaaggtgctaaatccagcaagcgttttttatgcttggaagataagaagaagcgttaaaccccttcttcttatgaagaaggggtttttattttgaaaagggaaggtgtcagctatatgtcacagcacgttgaaacgaaattagcccaaattgggaaccgtagcgatgaagtcacgggaacagtgagtgctcctatttatttatcaacagcataccgccacagagggatcggagaatctaccggatttgattatgtccgcacaaaaaatccgacacgccagcttgttgaggacgccatcgctaacttagaaaacggcgcgagagggcttgcctttagttcgggaatggctgctatccaaacgattatggcgctgtttaaaagcggagatgaattgatcgtttcatcggacctatatggcggcacgtaccgtttatttgaaaatgaatggaaaaaatacggattgacttttcattatgatgatttcagcgatgaggactgtttacgctctaagattacgccgaatacaaaagcggtgtttgtggaaacgccgacaaacccctcatgcaggaggcggacattgaacatattgcccggattacaaaggagcacggtcttctgctgatcgtagataatacattttatacaccggtcttgcagcggccgcttgagctgggagctgacattgtcattcacagcgcaaccaagtatttaggcgggcataacgatctgcttgctggacttgtcgtggtgaaggatgagcagcttggagaggaaatgtttcagcatcaaaatgcgatcggcgccgtcctgccgccatttgattcgtggcttctgatgagaggaatgaagacgctgagcctcagaatgcgtcagcatcaggcaaacgcgcaggagcttgcggcgtttttagaagagcaggaagaaatttcggatgtgctgtatcccggaaaaggcggcatgctgtccttccgtctgcaaaaagaagaatgggtcaatccgtttttaaaagcactgaagaccatttgttttgcagaaagcctcggcggggtggaaagctttattacataccctgcgacccagacgcacatggatattcctgaagagatccgcatcgcaaacggggtgtgcaatcggttgctgcgcttttctgtcggaattgaatatgcggaagatttaaaagaggatctaaaacaggcattatgtcaggtcaaagagggagctgtttcatttgagtaaacataattggacgctggaaacccagctcgtgcacaatccatttaaaacagacggcggaaccggggcggtcagtgtaccgattcagcacgcctcgacttttcaccaatcttcatttgaagagttcggggcatatgattacagccgctctggcacgccgacaagaacagctcttgaagaaacaattgccgcactggaaggcggaacaagaggatttgctttcagttcaggcatggctgccatctcaacagcatttttactgctgtcacagggtgatcacgttcttgtgacagaagatgtatacggcggaaccttccgtatggtgacagaggtgctgactcggtttggcattgagcatacgtttgtcgacatgacggatcgtagtgaagtggcgcggagcatcaagccgaacacaaaggtcatttatatggagacgccatcaaatccgacacttgggattacggatattaaagcagttgttcagcttgcaaaagaaaacggctgcctgacctttctggacaatacattcatgacgccggcactgcagcgtccgcttgatctcggcgtggatattgtacttcacagcgcgacaaaattcttaagcggacacagcgatgtgctctcaggtttagctgctgtcaaagatgaagagcttgggaagcagctgtataagctgcaaaacgcgttcggcgccgtccttggcgtgcaagattgctggctcgtgctgcgcggcttaaaaacgttgcaggtccgtttagaaaaagcgagccaaacagcgcagcggcttgcggaatttttccagaagcatccggcggtcaagcgcgtgtattatccgggactggctgatcatcccggcgctgaaacccataaaagccagtcaacgggagcgggcgccgtgctatcttttgagcttgaaagcaaagaggccgttaagaagttagtcgagaatgtgtcactgccggtcttcgctgtcagccttggcgccgtggaatcgattttgtcctatccggcaacgatgtctcacgcggcaatgcctaaggaagagcgtgaaaaacgcggtatcactgatggcctgctccgtctgagtgtgggcgtcgaacatgcagacgatttagaacacgatttcgaacaagcgctgaaagaaattgctccagttgcggttcgttaaaaaagaagccggggatggcccggcttcttttattattgttcgtcatcaggattcagaatcgcgaggacttgatgatcctcccaaacgccattaattttcacattttttcgggcgatgccttctttatgaaatcccgctttttctaaaacacgcatggacccgagattacggggcatcacaccggcttcaatccgatgcagtttcaattcgtggaacgcataatcaacaaccaatctgactgcctctgtcataatgccctttccattatgggctttgtctaaaaaatacccgatgaacgcagtttgcagcgcgccacggatgatttgaaagagcgaaaccgtcccgattaatctatcgtctgacgctgtaaagatgccaaaatgatattcttcatctttctcaagtctttcctgatactcggttattcgttttctttgcccctcaaccgtatagtaatcgtctgcgcgtatcatagaaaactgttcgaaaaaatcccgattttcgctttgcagccgcaaattttcttcggcatcctttccttctaaaggtctaacataaatggtttttccttttaacatacagtgatctctccgttctcatgtcagcattcctcttacattattctcagggaaatacaaatatcctttttataagaaggaagaaaaccaatttccaataaaagtgccaacatagttgccgattaagtagccgagcgtaccgacaagcatgatcggggcgacaagctcccgccatcccttggcaattgccatcgcagccgcagtcgtcggtcccccgacagtagcgttgacggcgagcagaatttcttcaagccgcacgcggaacaattttccggcagctaaggaaactgctaaattgctgatcgcaatgataaacacgaataatagaataagaggcgcattcgtgacgattaagcggagatctgcaggaatgccgatcaccacaaaaaacaaataaatcaaaaaggttccaagttcctgagatccattgagcctttcaaaaaaacgcgggaaaagaaaaatgataagaacagttaaagacgtaagcaccaggtactgatcgccaagcgtaccggtcagcaggggatgagaaaaaatgcttttaaaataaccggaaaccttcatactaaccgcaacaagtgcgaaagcggcaccggcattaaaagcgatatcctttaaggaaatatccttccgtttccaatagctttcagcactgtttccgctgttttcatcggcttttaccttctcttcaaacggcatggcataatgccgctgaaaccatttgagtgcaggaatgctgattaaaataaaaaacaaaagcgccatcataaaattatcagccacaacggtagccgacacatattcaccaggcgtctcaaattttgccgccatcgccgcaaagttgaccccgccgccgatataagaggcgctgatcatcccgccgattttatcgagataaggaatatgctgtttgagaagaaaaaaagctagaatgctcccaaggacagtgccagcggagctaatcagaaaaataaacagcaaacgcctgctttccttaaaaatttgccgaacattgatctgaaacaataaaagtggtatcgccagcggcaccacataagaccacacagtatcatacacaggcgactcaacaggaagcactcctacatttgtaaacaccatagcacctgccagcgcgataatagcacccgacacagcggacgcccacttaaagcgctgctccagcccgatgctcactgccgcccacaccgcaataaacccccacaatacccatgcatcatcagaagaaatcaaagaatgcaaaaccccatcacctctattgttagaaaattaagacatattataatagccggggaacggaacagcaagtccaaaaaaagtttttctaaaaaagcagttgacgaatagaagggaaggatatataatagaacttgtcagaaagacaacaacatacccagcaacacatacatatcatgattccgtagctcagctgggagagcgctaccttgacagggtagaggtcgctggttcgagcccagtcggaatcatagcttaaacccttgcgtagcaagggttttttactttgcttatttattgattttgtcatcattcatcgagttggggacgaattggggacgaaattaattttttgagctgattttgaaggggaattcaaaatcaactctgtttttgtgttaggtttctaggatcaaactggttaaagtgttttactgtgctattttcgagtttctcgataacgtgaccataaatatcactagttgttcgagcactggcatgtccagctcttcttgaatagcactgagactttcgccagcttccataaggagcgccaccatagtatgccgcaagtcatgaagacgaacatcttttaggccgtactattttttaattttagtccattttgcggtaggggttgtatagtagtaaggttttcctttaccactgtgaaatacatattgatgttctccgccttcccaggcatcgccaagcaacaatttttccacttgtttcctaaaaagacaatcaagcgcttaagtaattatatcttcaatatccaattatctattctatcgtctctttccatattaaaatcaactctaaaaactcatcagtttctataatactttcaaaaggctcatcaacccggcaatgatgctcagctattgtcatgtttttcttaattattatacttgtagcattcaacgtaatttcaaagtcttcataatctcctgttaaaaccttcttaacgtatccaatatactcgtctgcttcctcttttgttgaaatatcctcaaaaacgtccgagaaaacagttaatttttccggtagtattattcttgtgataccaaatggatcttttttaaattcatatgaatatctcatcttgtttttcaccttctatgctatttattatacaaaggataagcagtggctattgaaccatccttatttaagaacatttctattttaattcctgttgaattttcacctataaacttattagcacctatcttttttttattttgatacgcttcatcaatagcctttaacacatctacacgattccattccttcggaaaaaaactagatttggctatttttctcttcccactgatttcaacattggcttcatagacaccatttttattggtgttttctcggatccaggtataatttttccacccatcatactttcatgatgatatccaaccgctttaccgcgtctattaattcaccatggtaaatgtgttttatcgttcccgtattatatttacccgtatccttattgttagaacgttcagatcttctgagaacactctcttttttatcttctgcaatgctttttagcagcggaatatttttcacgttaatggttttctcagcatcttgaaggattccttctaatgcaggagtatatcggttaacaggagatttgacaaactgttttacggactgaccacctttcaataacagaagacttccgcccaaataagtaacatagtgcagccgtgtgtatgcatccccgtgtatcatttttgtattccaattatccttcaatgtgtcaaccatactttgaaaggcagcttgatagtcgtattccaaaacggtatccagcactttttgaggatccttgtttaagttatcaattgtccaactgatattccatccgaattgaatagctccttcaccggtatccttagcaagatcgtataaaccaacaatcgcacctttagcgctatcacctatgatttgcaacacttcttttccgttattcatgaaagctttacgctgttcaaggaataaaacaaattcaagctgttcaggggtaagattctcatatccgactttcttggcaatttttaagtattcgtccggatccgtcactccgtcagctagcttcttctttagctctttgatttctcgttctttcgcttcatctttcttgatcttcaaataagcttcagtctgtttctcgatatcgccttttttcttatgtatatcactttctcgataagctttggtattgtaatggattggtgtagcattcttgcctttgcctgtggattcctcaagtttttggaagtctttcttgatgaattgctcgtttggctctgactgggcatattcagtaacaagtgcttcgtccacactacctagtttgtcgactgtttttttgcgtttgtcctctgcatctgcaagttcgtctttaaagtcttcagttgaaaacagatcaagcggaaggatatcgtcgatattatgtaagatatctttcatggctttcttttgttcagacataatagattttgattttgtgtaggcgttagccagctcgtgttctaagaaggattcttctatataagcatcagataagctggcgtcctctagagtgcctgaaatgcttgtcaagaaagcaattttcatatcaagtaagtcaatccaattgtcagctacacctgcatggtcttgataaaatgctttaatgttgtcggcgcctttgccggaaaactcactgtcatctaaatcagctacagctttaaaagccttttttagattgaccatctgacttcttaattctttgtattcctttgcacgtctatctgcttctgaaagcagtgatttggcttcaaatactttcatgatcatatcctttcgtttgaatagctccaacaagattttaccatgggaaaatgaagaaatagacagcgatataattcaaaagtgtggaatgaataatttgatctgtgtcaatttacctattcggattatttgtttggaaactaatgacgcagtaagacgattccagttgatgaatggtttaaatcctaatggcatttatggcccgaaaactaaagcgaagctcgaatcccttcttaaataaaaaagcccttccgattgggagggctttttctcttatttaatagatacgtgatgtgtataccagtttccggttgcagtgaatcgtaattccatatggccgtggcggttacctccatactttacaaacgtgtaatcagaattggcgattgcatccttagccgttttgtcaatgtttgcaatttttttggaagtaattttaccattccagccagcaaaacctgaagcggatgcacttggcggactttcccactttgttattttctttccatattcgtatgaatagttgtcacttactcgaatatcatataattttatccctgtaaactttacagcgtaatatccacttgcagttttattttgggtggcctgtgttgttatcttttccaatcccatatctgtactgacgcccatttccacagtgaaaccattaccgagatcaatttcttgatatggatgatctttgctgacatgcatactgtttaaagccttattcacttctttaacagttgggattttctcagatgaaagggttctcaagtttttttgttttgttacctcgtaaaaggtcgccttatcaataatcagatcagaattcttgtccactttttcggcagcatttgcgctttggagactaaacagagatgaaaaactcaaagctagggcaaaaaccacacccacaagtaactttttcattttatccctccttaatgttttcgtccccatcttatcccggtgtataatattggtaaaagagacaaaagtaacaaatgatgctattgattaaagtattaggcttggaaggaaagggaagatcgaaaagtaaatgaatggttttacccatttaaacaaccatatatcaggtgtatattggattgtaggggagggatatcatggtcaagattatattggcatttgtttatctatttggcttcgttgtgttgagcaattgggctttcgacggaatattttcagagagctatttctcgccgatcggtttcctttggtctattttatttacatttttcacaggggtttataccggcttgcctttaatctacaaaaagtttactcaatcaagccgtttgactttgaaaagtaaaaagccaatttatttcactatcggtacagctgttattctctttgggctttattttctcaaaaacgaaatcgccccctattttatgctatgtggctattttttaactctggcatcaggtatagccctgaccatcttattacagcccaaaaccaacaactgtaaaacagtataaccaacaagaattaattaaaagcccgtcgttttttaggcgggctttatacaaatttaatcaaaaaggaatatttttaatcagaaacttatgtaagaaaaccctataaaatagggtttgggaataaaacgtctgttcgtgtcagaacataatctctaccttgtgacagggtagagatccctggttcgagcccagtcggaatcatagcttaaacccttgctgcgcaagggttttttactttttataggggctgtcggtttattaatgcagtatatgatttaaatgaaaactcaggaataatattgagttgagaagataaaataaaaaccccatttctaaagtccaaaatggggttatttcttaatatcatattaagttgctgctctatctgcgaccttataagtggactgctcagaaagagcgtatgaagcgctggatactccaacaatgccaagcaagagcgctaaacaaattgcaattttacattttttcatttaaatgtttccccctttgaatttgtttacgtgcttcaattgccatttgataaaaatcgaccgcatcatgtctgtcttctttgttggtcaaaaaatcagcaacagcaacagcgtattcttccatatcaccataaaggtttttctctttgaagaacttgaacacttctctaagtgtttgtaagtcaaatgataaataaagacctttaaccagttttaatttctcggttacttcctggttgttgtgtcgggcagcaaccttctgaccttcctggtataattctaacgcagcctttaaatcattcttctttgctttgacatacgccagattaaaaatcgctttggactcataaatgtgctttcgattcttatgaatttcataggcgatttgaaaatgtttctcagcattgtcaagttcttcaagattattataacataatcccacattaaaatgagctgaaccaattaaatgttgttcccctatttttatagcatcatttaaggctttttcagctgtttctaaagcgtcctcataacacattttatctagccagttcccaaagataacaaactgacattgaaccatttccttgccatatgtaaggttcccctgagcatctttttgctctttaaatatagagtatgctcgctgggcataattcattgaaaaatgagtctctttcatatagtaatagacttctgacattttgaaatagaactctgccttatctgtatttgcgttcttatctaataaatcaagatatttttcggcttcgcgataatatgttaaagcaataactaaatctctcgttctaaaatgatacatgccggtaaaaaaatgataaaagaactctattgtattggtgagggatgcactcgaagtcgtctaatgatttataaatggcatctatctttttcaagaaaatgttataatgaaaagccataaaatgataggagggggaatttcgatgcattacataacggcatgtttaaaaatcatcagtgataaagaccttaatgagataatgaaggaattcaaaaaacttgaggaagaaacgaacaaagaagaggggtgtattacattccatgcttatccgcttgagccatcagaacgtaaaataatgctttgggagatttgggaaaacgaagaagctgtgaaaacccatttcacgaaaaaacacacaatagacgttcaaaaacaagaattaacggaagtagaatggttaatgaaaagcaatgtgaatgattgaaaggctctttaaaaaaaagacattcaatgacttagaatcagccacttgtgattaagtagtaaattgttgtccaactcttatttttttctatttaatattttttgagacgaaaatgtttttttgagctgattttgaaatgtattcaaagtcagctctgtttgatttaaaggattatattctttggataacttgttaccatcataatggagatactccgtataaattggaggttaaaataatgagtcattctcaagaaaaaattgcactaattacaggagcaagcagtcaaggggatattggtacggctatttgtcgtaagttagcctcacagggtatacatatcttctttactcactggaattctgatacggcctggatagaagaatttcaacaagaaattttacgtatgggtgtccgctgtgaggcaatgaaaattgatttatcagatgcacatgctgcattcacaatacatgaaaaaatttcagataaattaggatatccttccatccttattaataatgcagctcattccgcaagtgataattatgtatcgttagatgctaaatcacttgatgagcattatgcggttaatatgagatcgaattttcttctttgtgttgaattcgcccgtcggtttaaaaaatctaatttaatatcaggaagaatcatcaatatgacatcagggcaggatttaggtcctttgcctggggagttagcgtatgcagctactaaaggagctatttctgcctttactaggtcgttatcacaagaacttgcaccattgggcatcactgttaacgccgtaaacccaggtccaacagattctacatggatgacagatgaaataagaaattttctttcacctaaatttccaatggggcgtattggcacaccagatgatgcagcacgaatgattgcttttcttgcaagtgatgaggctgaatggataactggacaaattattcattcagaaggtggatttattcggggctaagctactgaaacacaatatacaccaatgtatgatgtattcccaaaactaaatctaaacttgaagcgcaattgaaataaaataaggtcccttctctttttagaggggaccttattttattcatgcatgttttgcatccagaaaatctggcggataagagattaataaaccgttacatatacttttccgaatactgcagtacctttaaacaaagtaatcgtggctttcccttttgatttagccgtcactaaaccattttgatcgacttcagcaactttttggttatcagtccaataacgagtagctgaattatttttaacagaataggtttctccaacttttagaggtaaattatagtcttgaatcttgataacatgtgtaggtgaaatagaaatgttctttacttcagtaggtgtggagtttatttcatgagctgaagctaccccgctgaccgacagagctaacgcagaaatcgataaagcagaaacaacagtttttttgaaattcattttgaaacactcctttaaagttttttgtcttgcactataacaattcaataaaagtaattattttccttgtaaataaatgttaataatatgtgaacgatcaattgatttgagctaagaatattgtgtgcgctgcacagagtttgtatttatgattgaaaattgctgagagagaatggccatccttaaaatgttaatagcacacatttgaagggtattagtttgttgagcgtgtgggaattttgttacctgcactttatccccgaagataccaaatcatttttcttcatcatgttcttactttcgtactcatacattagaaaatcttcgttctaaataggtgaagaattggagtatttttatgaatttctgctgaatatacattacatagcaaactcaaagagtataaaaatcgcttttttccggaagcttcggtaaaaaacaaaacttttgtctctatgattttattttataatgtaaacggtttcttatatattatacttatactatcaatttgctcaagtagatactgacaggaaggatagaaaaacagatggaatacataaatacaagacaaaaagagattttgtatctgttgttatctgaacctgatgactatttagttgtgcaagatttcgcagatagggtacagtgttctgaaaaaacaatccggaatgatttgaaagtgatcgaggattatctcaatgagcattctcatgcacagcttattcgaaaaccagggttgggcgtttatttacatatagaagaacaggagaggacctggctaagccaacaattacatactgatcatttttcttctaggcagcggaccgatgaagaaagaatgctgcacattgcttatgatttattaatgaatccgaagcctgtttccgcaaaagaaattgccgctcggcattttgtcaatcgatcttccattaaaaaggatttatacgcagtagaagagtggctgaagcgttttgatctcacgctcgtttctaggcagcggcttggattaaaggttgaagggaacgaaagaaataaaagaaaggcattggcaagaatatctgatttgattcacaatacagagtttacgagccaatttattaaaagtaagtttttacattatgaagtagattttgtgacgagagaaatcaaatcattacaaaaaaagcattctctctatttcacagatgaatcgtttgagagtttgctgctgcatacattattaatggtccgccggatcaaaatgaagcagccgatctcgttgtccccgaaagaaatggcggcagtaaaaaagaagaaagaatatcaatggacatttgcttgtttgcaacggctcgaaccggtttttgcaatccgttttccagaagaagaagccgtgtatttaacattacatatattgggcggtaaagttcgttatccattacagaaagaagaaaactttgaaaatgctgtgcttcctaaggttgtagagcatttaatcaatcgtgtttcagagctgaaaatgatggattttcataaagacctggatttgatcaatggtttgaacattcatctcaatacagtgttacagcggctgagctacgatctttcagtatcaaatcctatgctgaatgatattaaaaagatgtatccttatttgtttcatcttatcattgacgttttggaagacatcaatcaaacatttgatcttcatattcctgaggaagaggcagcatatttgacactgcattttcaagcagccatcgaacggatgcagtgcagcagcgaggcacataaaaaggcgatcgtcgtctgccacatgggaattgggatgtcccaattgctgcggacgaaaattgaacggaaatatcaccaaatcgctgtaatggcttgtattgcaaaggccgatttaaaggattatatcaaaaagcatgaggatatcgatcttgtcatatccaccattgcgctggagaatataacggccccccatattgttgtgtctccgctgttagagcctggcgaagagaagaaattaagtgcatttatacgtcagctgggcgaaccacaccgccaaaaacaaaaaacgtttcagatgctgaacaatacgactccttttttggtttttttgcagcaggaggcggagcatcgctacaagttaattgaacagctggcgacagctttgtttgagaaaggctatgttgaaaaggactatgcggttcatgcggtgatgagggaaaaaatgtcggcgacaaatattgggtcaggcattgccattcctcatgcgaacgctaaatttattaaacaatcagcaatcgcgattgccacattaaaggagccgcttgaatggggaaatgaaaaagtttcgcttgtctttatgctggctgtcaaacacgaggatcaaaccatgacaaagcagctgtttagcgagctctcatatcttagcgagcagccggcctttgtccaaaagctgacgaaagaaaccaatgtcatgtcatttttatctcatttggattattaaaaagcagggattattccttgcttttttttgttatagggaaaaatgcctttatttccggaacctatggtaaaaaaagcgatttttaagtgctgatttcggtatacagttgagacaagatctgattattcacactttaaaggaggtttcctatgaaactgttagcgattacttcttgtccgaacggaatcgcccatacgtatatggcagcggaaaatctgcaaaaagctgctgacagaatgggcgtcagcatcaaagttgagacccaggggggaattggtgtcgaaaataagctaaccgaagaggaaattcgcgaagcggacgcaatcattattgctgcagaccgctcggtaaacaaagaccggtttataggcaaaaaactgctatctgtcggggtacaggacggcatccgcaaaccggaagaattgattcaaaccgctcttaacggggatatgccggtctatcgttccgctgcaaaatcggaatctggcaatcaccaggagaagaagcaaaatcctatttaccgtcatttaatgaacggcgtttcatttatggttcctttcattgtcgtcggtggattattgatagcggttgcattaacgcttggaggggagaaaacacctaaaggcttagttattccggatgactccttctggaaaacgattgaacagatcggcagtgcttcattttcatttatgattccgattttagccggctatatcgcctatagcatcgctgataaaccggggcttgtgccagggatgatcggcggttatattgcggcgactggaagtttttatgacagcgcaagcggcgccggattcctcgggggattattgccgggtttttggccggatatgctgcactttggataaaaaaattaaaagttccaaaagcaatccagccaattatgccgattattattattccggtgtttgcatcactgattgtaggtttagcgtttgtgtttttgatcggcgcgcctgtagctcaaattttcgcctctttaacagtttggctggcggggatgaaaggctcgagctcgatccttctggcattgattttaggtgcgatgatctcatttgatatgggcggtcccgtaaataaggtcgcatttctgtttggatcggcaatgattggagaaggaaattatgaaattatgggaccaattgctgtcgccatttgtatcccgccgattggccttggtgttgcaacgtttttaggaaaaagaaaattcgagacatcccaaagagaaatggggaaagcggcatttacgatgggactcttcggtattactgaaggagcgattccatttgcggcgcaggaccctctgcgcgtcattccaagtattatggcaggctcaatgacaggttctgtgatagccatgattggcaatgtgggagacagagtggcgcacggcggacctatcgttgcagtgcttggcgcagttgatcatgtcttgatgttttttattgctgtgattgcaggatctcttgtcactgctctgttcgtcaatgtactaaaaaaggatattacggcgtctcctgtgctcagtgaaactgcaccgccctccgcgccaagtgaagctgcggcagcaaatgaaataaagcagccaatccaaagccaaaaagctgagatgtcggaatttaaaaaactgacagacattatcagcccggaattaattgaaccaaatttatcgggggaaacgagggatgacatcatagatgaattgattcagaaattgtcccgaagaggtgcgctgctttcagagagcgggtttaaacaagccattttgaatcgtgaacaacagggaacaacggcgattggcatgaatatcgcgattccgcacggaaagtctgaggcggtcagggagccgagtgttgcctttgggatcaaacgatcaggcgttgattggaatagcctggatggatcagaagctaaattaatctttatgattgctgtaccgaaagagagcgggggaaaccagcatctcaaaatactgcagatgctatctcgaaagctaatggatgacaattatagggagcggctgctctccgtgcaaacaacagaagaagcctacaagctgctagaagaaatcgaataaagcgggggattttcatgacgactgaaccgttatttttcaagcctgttttcaaagaaagaatttggggcgggaccgctttagctgattttggctataccattccatcacaacgaacaggagagtgctgggcttttgccgcgcatcaaaatggtcaaagcgttgttcaaaacggaatgtataaggggttcacgctcagcgaattatgggaacatcacagacatttattcggacagcttgaaggggaccgtttccctctgcttacaaaaatattagatgctgaccaggacttatctgttcaggtgcatccgaatgatgaatatgccaacatacatgaaaacggtgagcttggaaaaacagaatgctggtacattattgattgccaaaaagatgccgagattatttatggccacaatgcaacaacaaaggaagaactaactaccatgatagagcgtggagaatgggatgagctcttgcgccgtgtaaaggtaaagccgggggattttttctatgtgccaagcggtactgttcatgcgattggaaaaggaattcttgctttggagacgcagcagaattcagacacaacctacagattatatgattatgaccgaaaagatgcagaaggcaagctacgcgagcttcatctgaaaaagagtatcgaagtgatagaggtcccgtctattccagagcggcaaacagttcaccatgaacaaattgaggatttgcttacaacgacattagttgaatgcgcttacttttcggtggggaaatggaacttatcaggatcagcaagcttaaagcagcaaaaaccattccttcttatcagtgtgattgaaggggagggccgtatgatctctggtgagtatgtctatcccttcaaaaaaggagatcatatgtttctgcctcacggtcttggagaatttaaactcaaaggatatgcagaatgtatcgtctcccatctgtaacatggcagggcttgagaaataaatttgcgagtgaagacgcctattctccagcaatgatctaactaaaataagagtttaatagttggagaagaaatgttacactcttttctgtatatggtaaagaatgaaaaaacacgattcggttggtagtccggatgcatgattgatcatgtcagtaaccttcccctcctcgggatgtccatcattctttaatatcttttatgaggagggaatcgttatgaaattaacggtttactatgatggtcagttttgggtaggcgttgttgaagttgtgaacaatggaaagctaagagcctttcgtcatctttttggcacagagccgagggattctgaagtattagagtttgttcataaccaactcctgaatatgttggcccaagctgagcaggaaggagtttgtttacaaggcagacgtcaaaaaaagatcaatccaaaaagattgcagcgccaggtttcaaaagagttgaaaaacgccggagtagcttctaaagctcaagaggcgataaagctagagcttgaagcaagaaagcaagagaaaaaacaaataatgaaagaacaacgagaacatgtaaaagagcaaaggtatatgctcaaaaagcaaaaagcgaaaaagaagcacagaggtaaataatccaaacaaaagcaggcgcagtgcctgcttttgtaattaaggactctacttcgtaacatatatccaatgtttataatccgctgatttatgatccaatataaaccctaacttctccaaggttttttgtgagcctagattatcatgttcacatcttgcggtgatccgggatactgtttcttggcttaatgcccagtttattagtttttgggcggcttccacacaataacctttgcggcgatgacttttatttgttgcaaaaccgatttcaatcatgccattttcgtctgggtcacctaaaaatccagttcccccaacaatttcatgactgtccttctttacaataatccatgaatcaaatccttttgttccattgtttttgactaaaatctcgcggaaataaggtatcgcttcaaaaaaatcagaatttggccattcaccatttgtttcataacctaagtctttgatagcctgatgatcttgtttagacgcggcgtcaagaaggggaatatcaatcgtttttaaacgtaatcgattcgtttcaaggagaaccatatatctaatcctcttttctttttactgggaataatgataacatataacaattttctctgataccttggcagtagagaaagatgaaaaaattgaggggattgaaagagtgacaggtgagagtttgcccagcccaaaaacgggtaggaaaatgctgatgttaatgtgtccctacccgtttttctgttcctgaatgcagggtttctgataacatgttgtgctaccttttcgcaatcaaataaagcgatatggctctttgggtttgcacaggattatgaatgataatgacccattggtttcttcgtcttggaaagcttgctaccgcatacaatggagcagtatcgcgcggagtgaacccaccatttatcacgttgatatctcttccttctagatgacaaactaagtattcacctggattgatgacctgttggttcgtccatgcgtaagaataaaagccgtctctaagatcttcggtggaagatgggggacaaagccatccacagtcaatgtgatttctcttcttcgctgtctttctgaaaagtctggacttctttgagggttatgagtatgtgaaaagtaaggaattaacgcagggccataaaagtaatgatacaaagcaaccactcctttattttccattcatacaaattgtatgtgggagttatttgttcattcctgttttgttccatgtagactaataatgggctataggtgtccaaggtaatcaatttgtcctttcgttgttcaatgctagtaaccttgaaaatgcaggttaggatgatagaatttacatattactgcaagaagttagacatacatcattttgatagtgggtgaaaacgatggcgaaaaaaatggcaaaaacaaatgcggttcgtctgatagaacagcagaacatctcttatgagttattagggtataaaacagacggccagcctgtagatggcatctctgtttcggaaaaaatcggttatcctgtgaaatatgtatataaaacgttggttgcagcagcaggaacaaatcattattatgtctttgttgtacccgttgcagaagagttagatgtaaaaaaggcagcaaaggtgacaggggaaaagaaaatagaaatgattgcaatgaaggagctattagcggtaacaggctatcttcgcggcggctgctcgccaattggcatgaaaaaattgttcccgacctatattgatgcatctgcagaaacgcttgattttatcattgtcagtgcagggaaaatcggtatgcagctaaagttggcgccacaagatttagccaaatcatgtgatgccgcatttgcaaaaattgtatagatgcagatataggggaaacgaaaaagcttagtcatatcgattaagctttttccgtatctctttcaaatatgatttcaaaataagcagctgccccatacccatctatactgggagcgaaaatctgaacgaatctccagcctcttttcgcataatcatggatgatttgctggtagtcttctttaggccttcttctcatcgtgctcagctcaactcttacgaattcatattctttcattgtttgatccctcctattaaggtatacgcataattgagcaagaagttccgaaaacctaggttaaggtccgaaagtatatttcgctcactaaacaaatacatttatgccagatgcctgcatgcatctgggaagagttaaggggctataaaaacgaattttaccgggtcagcagttcaaataaatctcttgcttattgcatttgactgagtatataagtaaaaaaagagcggccagaacatataagaaggagatgatcattaacgcactcataacagggtagtgtttagcggagtagatgaaaaaatcaagctgtgaaatttgtttggggctgctgacggcatcaattccatttagcagttttgagagtttagcagtatagttccaatcaaatcgatctgaaacaagctcgcttccttgataccaattaacagcagctaaaaacagaaatatcataatagaaaatccaagctgaacaactaaaaatattcccttcacttttatatgacctccaaatctatgaatatgggaaaatcaaacaatatattaccaccgtatgggttattcttgcaatttcactttcatacaactcaaacgcaagtctatttttttgtttgtttttggcttataatacctgatgatggaaaaagaatgcgggtttatagattagagaaacaaatgtatttcttagcattttttatttgtggagagagtatagaagcattcgattagatctgctttttcacagaaacggttttcatctgtttgcctgagctttacaattggctggcagaaaaacaatgatttctttcaatcaaaacatgcaacgatgcgacacattttatatcttgatgacttatctcattgcctttaagtcatcctatcgagaaagcgatggtattttatgaacaaagaaaccctaaaaaacatactcatgattttttcaatatgcgcaaccctccgagaaaccgatggtatgcgcatagctgatagctggattttgagtgagattatacgatttttgatttgcatggctgtgttttttgccgtgacatttctattagatgctgtttttccaaacaaaaaagagtcacattaatgtgtggctctttttgcatcatctgatcagaaacatcataaatgaatcgatcatcatgatgaagaacagcaagcaaaaataaataagcgagtagacaaacatatcctttgcccacttcacgtcatcgtctgttttgaatcccttgatgctttttttgatccatatgcctccgagaaccaaggcggctaagaaataaaatgggcttatatggccggtgccgagagagaaagggaataatagcgtgaccggcaccaggacggcaatatattgcatcatttttatttttgttacatggttgcctttgactactggcaagagcggaacgccagcggcacgatattcttctttgcgtcttatcccaatcgcccaaaaatgcggcggctgccacagaaacataatcgtgtacaacagcactgctgtcatactgaagtcaccggttacggcacaataccccatcaatggcggcgcagctcctgggaagctcccgacaaatgtgctccacacagacgttcgtttcacccataccgtatagatgatcgcataaaaaataaaggcggccagtccgagaaaggccgttaatggattgagggaataaagcatggcaagacctgtgattcctaaaacagatccatatgttaagatcatggctggcggcattttccctgtgaccgaggccctgctgcgagtgcgtgccatttttgcgtccatatgccgatcaaaatagttgttatagacagtgccggaagccatcacaaacgcggttcccaacattgctgtcaccattgtcatcaaaaaagccattccggttaacgttttttctgcgcttgcaaacgcgatccaaaacccgccgaaggctgctatcgagtttgatatgataatgccgggttttgcaagtttgataaaatcgtaaatggttacccggttcgaagcttttatgtattttgtttcagatatggctgcagaatcccttgtattctccaaaaatagacgcctcccccaaaactgcatgcttttgttatcgtaacaagagggagacggaatcacaattatttcctatatttgtcatgatattgtcatttttaaaataaaaaaatggggagctggactgcccccattttgatatgcggcgactagtaaccgtaacctccgccatatcctccgccataaccgccgccgtaaccgtaccaagggtagtaaggcggtctcgggcgcgggtagtaataaggcgggcgcggataaaacgggtagaacggataatacggtcttggataataaggcggataaaatggcggtctcggacgcggataataataaggctgtctttcatcataaggggtaatttgttcaaatggctgttcattcaaagggtaatccaagaggaaaacctccctagctttttttattccttttactatattcttgatgcttaagttgggtgtatgtacattcatgaaactcggttttttttatgatgaaattccttaaaaaggattgacatgaacttctaaatctcatagtattacaaatgtgaaataaatgttactacaatgttacaaaatcatttctaaatagatacagttccaactgatgaagagtaaatcgaaatggctacgaaagaaggagtttttgttgttggcaaaaagaatcaaatggtttcatgtattaatagcagttgtatgtgtggtgggccttatcggctttttccataatcattcattgaaaaaagaaacggtcatgaataaagtaagaactgattctcaatatgggaatgttgagatcgcaacgcttgtgaatgacgggaaaacttttaattacgcggttaactatcccgttttcaaaaatgaaaaaatggattcggcattaaaaagattcgcagaaaaagaggttcgtcaatttcaaaaggaaacaaaagacgttgaccaagagcatacgacaaaacgcaacgaattaaatgttgattataaaattgtccattatgccaaacagacagtggcgattgtatttaatgaatataaatacatcggcggggcacacgggcaaaccgtgaaaaaaacgtttaactatgattttagtaaacaagcgtttctttccattgatgatattttcaaagaggacgctgactacttacataagctttcgttaatcgcttatcacgaactgaaaaagaataaggacattgcagcggacgatgcactgttaaaggaagggacggctccgaaaaaagaaaatttcagccgctttgccatcaaggaggattatatcgaactttactttgacacatatcaggttgcagcaggctatcttggagagcaatcgattgccattaagaaaagtcttttgaaagacattctgaaagaacaatatattgataaagcaaaaaataaaaataaaatcaaagaacaaaagccgaagcatgaagtgatttctttacccaaagaggaaacggttgatccaaatcaaaaagtcattgcgcttactttcgacgacggcccgaatcctgcgacaacaaatcagattctagactccttgaagaaatataagggtcatgccacgttttttgttttgggagcagggttcaatattatccggaaacgctaataagaatgctgaaagaaggaaatgaggtggggaaccattcatggagccatccgcttctcacaaggctttcagtgaaagaagcgttaaagcagatcaatgatacgcaagacatcattgaaaaaataagcggataccgtccgacgcttgtaagacccccatacggcggcattaatgatgaactgcggagtcaaatgaaaatggatgttgcgttatgggatgttgacccggaagattggaaagaccgtaacaaaaaaacaattgttgaccgtgtcatgaatcaggcgggagatggaagaaccattttgattcacgatatttaccgcacctctgctgatgcggccgatgaaattatgaaaaagctcaccgatcaaggctatcaattggtgacagtttctcagcttgaagaggttaaaaaacaaagagaagcgaaataaattaaaaaaggctgtccgtacggacagccttttttctatttaataagagcctgtggtggcccaaacatttaagtttggccctgaatacttgccgaaagcgtaagaagtccttggatctaaatcatataccatcggtgtatagcaagacttttggccggccaccgcttttccattgccgcctgcagaatcacaattatatctcttgccgtccgtgtttcgggtaatctccgcatttgcttcaaagccagacgtcaatgtattattcatcgtgatttttgcccaagccgttttacatgtactgctgaatttaagctcgactactccgatgacttgattgcttgcattcactaagtttgaggatttttttgtagagccgctggacgcacaatcattgtaataagggctttttccatcgtaggcatgggtttccgcattggcgggtacacctttgacggcaaaaacaaatactactgcgaataacaccaatgaagccttcgtaaacagtcttttcatatcctttatgacctccttaatatggcaaacaataaatcatacggaggaacaatcaaaacatgcatgcttttttgtgaacaataaaggcggccgggaggatggagttattggccgcctttggtgtgaggttaagcttttacatcaatggtttgtccgagagtcggatgctgaatcatctttaaggtttgatcggcattttgctgggcggtgtccagcatttttttcgttaaagcgatattaacattctgggcaagggatgcttgatgcattgcaactgataaagcaggaatatccatcgttccacctcctatgtcttacctatcggcggctttgtatcattttacagtgaaaaatggcttaatttctcctgttgacccttacgctagagcataccgtatgtttttgacaaggagggatcaggatgaatcttgtaatggaaaagacctttgagcaatacgaaaagctgttttcaatggaagaacagaaaagagaagatgaatttcggtatacgatgatgaggccgtttgaaaagatgtggaccgccatccaagttccgctgaaagcgaaggagccaaacggctatgatgtgatcatggctgcgaaaatgctgggctatttggatgtccgtgatgctgaaagcgggcagaaagcactgcaaatactgaaagaatcacatgtttcagagacagctgagtctgcacttcggcaatgcatattttttgctgagcgcgaacagctgcgggtgaatgcagaggagatcaaattcggcctttatatcgctgatccaaataaacttcagctgcaaaaaggctactgcgggtttggcgggataccgggctttattcatgtatggattgatccgaaccgttataacctgccaaggattccttcaattattgctcatgagtttcatcataatgtgcggttttcgtatatagattttcatcatggctctgtaagtgtcggggattatcttgtgattgaaggattggcggaatcattcgccagagagctgtttggcacggaacgattgggcccttgggtaactcgttttgatcatgaggatttgcaatattccattgatgtgattaatgaggtgctggatgtgaaaggattttcggaagtcagccgttatatgtttggtgatccaattgctaacgaccaaggctttaagcctgcaggtttatcggcttttgcgggttatgcagttggctatcatgccgttcagtcatttatgaatcaacatcatatcacgataagcgaggccacgcgtttggatgcgaagaccattctttctcagtgcggattgttttccaaatgaaaaaaagcgtcacatacagcggcgctttttgattcccaaaaccagcagttctatggcggcacaggcggcaattccgattgtatatgcttcgatatcgctccataaaaaaccgtaccccagtacaagtccgccaagagaagtatccctaatctgatcgatccattcggcatgatagagctggctgaattcaatgacaaaacagaaagaaagactgataatgcccgttatcattgtcttcagcttccgaaatagaaatccgcatcccgtaaagatcatggcggcccacaacgagtccccaagataagtattgagggtatcaggaagaaccctggagtatgctctggatccaagccccagcccaatgatcagtaaggtgaaaactgcatatatccaacgatttcgcttcattgcgaattgataccccgtctctgcttcatctccctgtattgtaaggaatatagcttttatttgtccactaaaaaagcggctgaatagccgcatagggtgtttattttgcttttaggtttacatggtcggctgtctgatccgtgcctattacaaaatggagttcatagcggcctgtatcatatacataatcgatttcatcggtaaacgggacggttaacacccgatttgctggccctaattgcttctgcagcacttccggcgtaactccgcctaaattcagctgccgttccacaccggttccaaagtagcggatttctgaaattgtcatgtctttatgataggaaaatccgtagcccggctgtcccatattccagtgatataaatcaaatcgattgtctcccccgactggtctttccggttccccaaacgcagcgtggacatccccttttgtgcttttgttaatggtaaggccttgcgcctgctgaggcatttcccctttgtaggcggtgttgtaaaggtttttgacgagctcagtggctgattggtttgtattttcatagagtgtatttgtttgagctgcggcctttgccggtgctgaaaaggacgcagccccaaagccggtaaaacagcttgttactgctgccgcagcggtaatagcagacattgtctttttcatgttgatccctccttattgatctaccatcccgtttcccggtgttagtgcaataaaacatgtgagtgcgctttgtatgttttattgagttgttgtaagggaactgaaataggtaattcggtatataaagcaagaaaggggaatggagatgcctggcaagaaaaaaatcacaataaacggcgttgaaatggaagcgtccgaggaacagacggtgctgcagcttttgaataacagctcgattgaagtgccgcaagtttgctatcatccaagcttagggccgattgaaacatgtgatacgtgcatcgtcagcatcaatggtgagctgaagaggtcgtgctccgctgaattaaaggatggggatatcattgatacgctctcacctgacgtgaaaaaagcgcaggtcatcgggatggacaagattttatataatcatgagctttattgtacagtttgcgattacaacaatgggggatgcgaaatacataatacggtgaaggaaatgaaaatcaatcaccaaagcattccgtttgatcacaagccataccataaggatgaatcccatccgttttatcggtatgatccagatcaatgtatattgtgcggacgctgtgttgaagcatgccaggacgttcaggtaactgaaacgctgaccattgactgggagcggaaacgcccgcgcgtcatttgggataacgacgtgccgatcaatgagtcgtcatgtgtgtcatgcggccattgttcaacggtctgtccgtgcaacgcgatgatggaaaaaggaatggaaggggaagccggatatttaacaggcatcaataacgaaacgctgcgaccgatgatcgagatcacgaaaggcgtagagacaggctacggctcgattctcgcgatttctgatatggaatctgctatgttcgatgaacgaatcaaaaaaacgaaaaccgtctgcacgtattgcggcgtcggctgcagctttgatgtctggacaaagggcagagacattctgaaagtagagccacaggaggaagcgccagccaacggcatttctacttgtgtgaaaggcaagttcggctgggatttcgttaacagcgaagaacgcctgacaaagccgctgatccgtgaaggtgaccatttccgtgaagcagagtgggaggaggcgttatcgctgatcgccagcaagttcacggaattaaaagaggcgtttggcccggattctctcgcttttattacatcttctaaatgtacaaatgaagaatcctatcttatgcaaaagctggccagaggggtcattggcacaaataatgtggacaactgctctcgctattgccaatctcctgcgactgccggcctgttccggacagtcggctatggcggtgattcaggatcaattacagatatcgcgcaagcggaccttgttttgattatcggttcgaacacgtctgagtcgcatccagtcttatccactcgcattaaacgggctcataagctaagagggcagaaagtgatcgtcgccgatatcagaaaacacgaaatggcagaacgctccgatttatttgtccagccgcgtgccggatcggatatcgtctggctgaatgcgatcgccaaatatttaatagaaaacggcaaggccgatgaacgatttttgagagaaagagtgaacggacgaaatgaatatgtaaaaagcctcgcgccgtacacacttgaatatgctgaggagaaaaccgggattgatcgagaaacccttatccaaatggcagagatgatcgggcaagctgacagtgtgtgcgcattgtgggcgatgggcgtgacacagcacattggaggaagcgacacgagcacggcgatctctaatctgctgcttgtgacaggaaactacggaaaaccgggagcaggttcttacccattgcgcggccataataacgtgcagggagcaagtgacttcggaagcatgcctgacagaatgccgggctatgaaaaagtgacggacgaacaagtccgccaaaaatacgagcgggcgtggggcgtgccgctgccgaaggagccgggtatgaccaaccacgaaatgattgaaaaaatccattccggacagctgaaagcgatgtatgtaaaaggtgaagaaatgggcctggtggattccaacatcaatcatgtacacaccgcatatgaaaagcttgatttctttgtggtgcaggacattttcctttcacgtacagcggagtttgctgatgtggttcttcctgcgagcccaagccttgaaaaagaaggaacctttacaaacacagaacgccggattcaacgtttgtatcaggtgtttgaaccgctgggcgaatcaaagccggattggcagattattatggaggttgccaataagcttggcgccggctggcactatgagcatcctgcagacattatggagaaagcagccaagctgtcgccgttttatgccggtgtcacctatgaacgtcttgagggctataattccctgcaatggcctgtaaacgctgatggaaaggattcgcctttactctttacagagcgcttccctttcccggacggcaaggccattctctaccctgtccagtggacagagcctaaggaattcggtgaggaatatgatatccatgtcaacaatgggcggctcttggagcacttccacgaagggaacctgacttacaaatcaaaagggatttcggagaaaacaccggaagtgttcttagaaatttctcctgagcttgcggcagaacgagggattcagggcggaaccctcgtcagactcacatcgcctttcggaaatgtcaaagtgaagtgcctgattactgatcgagtcaaagggaaggaagtatatctgccaatgaacgattcaggggaagcggcgatcaacctgttaacaggcagccatgccgataaggataccgatacgcctgcttacaaagaaacatcggccaagatggaaattttgaagcacgacggaatcagcccgctgcctaagatcaaccaccgcaacggcaatccgcagccgcaaatcggtgtgcaggttcaaaagaaatgggcgcggaaggattatattttccctggtgacgccgtgaaaagggggatgggccataatggctaaagcgattaaacaaatccagaaaatcgaggtaaccgaggaggatcagcgaaagcgtgatttacgggaaattgaagatgctctagttgatcacaaagaagcgattctcgaaaccttgcatatgctgggccatatgaacgagcgcggtgtcctgccgttgctccgcggcctttttggccaaggggataaagttcttgatatcctggtgaaaaaggcagatacagaggaaacagccaatacgctgaaaaatctgcttcttctgtttggaacactcggcatgctggacgtgaaggagctggagcctctcattttgaaagtgaatgcgggtgtggcaagcgctgtagagcagaaaaacagcgaagaaaagacaggttattttgatattatccgctcgctaaaagacccggaaatcaataaatcaattacactgctcttttcctttttaaaaggaatgggacaagatacaaaggagctggaacgcacgacgcagcctccggaacaccaaaaacatcatcaggaacccgagagaaaagaggaatgaacaagcgagattgacctcccacccgagccggcttcagccagctcgggtttttttatgaggtgagtcttaggaactaggatgaaatatctaattcagaaacaagacaaagtagctttgattttggaaaaatgaaatgacagcataggcccgtccagtattttttcagtagaggatagatatctatatcattggctgacctataatatgactggaaatgatagagtaatttgttactttgttctctgttaagaaaaggaaaagcgtgattataatagaaaacgattactttagatggaggaacagcaatgaaaaaagcattattcattttgtttgtgctagcgattggctttgcgctttctgcgtgcagcaagtcaagtgatgcgtcagctgagcaaaagacagcaaagaaagaagcaacagcaacggaaaagaaaacagaggaaaaaaacgaaaccaaaacggacgaaaaggtgcataaagtaggcgaaacttttaaagcttccagcacaaatttctcggtcaataaagtatatacgacggcagaacaaggtgaatataaggcgaaaataggagataaagaaaaaacaataaatcaaaaggaagaatttttaatagctgaggtatcgatcgaaaatacaagtgacaagcctttcaattatacgagtggcggttttgaattgaaagacagcaaggatgaatcgatcagagcaaacatagtatctactgctgacctgaaaacaagcctaaaatcagggaagttagcctcgggtaaaaaggtatcaggcacagtcagttttgtgattccaaaaggagaaaaaaaccttactctatcatataatccatcatttttaaattttgaaacagaggatattacatatttggtaaaattgaattaaggtatcttttgagcatgtcaccggaagatcggaacatgctttttttatttcaaagagacttatggtataaaatggtagtgaggtgatcgattatgcaaaccaaatggctggaacgggcacagcggattcgggcgatcgcccaggcggggcttgctttttccaaggatgtgtacgacagggagaggtacgaagagctaatgaagcttagcgcggaaatgatggcggattactcacagacggacattgaagttatcactgatttatggaaaagggagagcggctatccgacaccgaaagcggatgttcgcggcgcagtattccgagagaatcagattttgcttgtccgggagaagcatgatgagctgtggtcgctgccgggtggattttgcgagattggtttatcgccagctgaaaacgtcgtcaaggaaatcaaagaagagtcggggtacgatacagagccgtctcgattgctggccgtgctagacagccataaacactctcatcccctcagccttatcactattataaaatcttcatcgcatgcagcatgacgggcgggcagggggaaacagggatcgagacgaatcatgccgctttttttccggaagacagactcccgccgctttctcctaaacgaaacaccccctcacagcttagcatgctgtttgactttttgcgccatccggacaagaaaacgatatttgactaaaaaataaagagcctatgggctctttattttttataatgtaatgtgtttttcgttggcgagtttcagaagggtcaaaatagaatcggcttgtttatggccgagtttttgctttaatttgttttcttcaactaatcggctgccataaattttgacagaggctttgtcgacgacagtatgccagttttcctgtttttttccctcaacaagcggtttttcatgtctctcagaaaaagagaatacaaacagtacgaatgcaagtgaaagtaggatgccgacaacttgttttttgtaatcagtctgtgctgccacgttgttctctccttcaccttttaccttctatttaatcatagaatcagcttattttacataatgggaaagtcatttttggagttagtgcatttggttgaaaacagaggcgttttttgagcggagcggtgcaattgaatccatattggatttgcgtgcttatgcctaaggtcacgttgtgagccaaaacagcagtgcagaatagaaaaaaattgaaagattatggtaagatgaacgaaattcgaggggaatatatgatgcctgcatcgaacatcgtgatagcctgcctgctgttatcaatttgcttatatgtggtagtccctctctttttcgaaagcgggaggtgaagtggaacattcattgctgaattctttcaagggagtgaccataatgagtgtgttaaaccgccggcaagccttgcagcgagcgctgctcaatgggaaaaacaaacaggatgcgtatcatccgtttccatggtacgaatcgatgagaaaggatgcgcctgtttccttcgatgaagaaaaccaagtgtggagcgtttttctttatgatgatgtcaaaaaagttgttggggataaagagctgttttccagttacatgccgcagcagacaagctctattggaaattccatcattaacatggacccgccgaagcatacaaaaatccgttcagtcgtgaataaagccttcactccgcgcgtgatgaagcaatgggaaccgagaattcaagaaatcacagatgaactgattcaaaaatgtcaggggcgcagtgagtttgaccttgttcacgatttttcatacccgcttccggttattgtgatatctgagctgctgggagtgccttcagcgcatatggatcagtttaaagcatggtctgatcttctggtcagtacaccgaaggataaaagtgaagaagctgaaaaagcctttttggaagaacgagataagtgtgaggaagaactggctgcgttttttgccggcatcatagaagaaaagcgaaacaaaccggcacaggatattatttctattttagtggaagcggaagaaacaggcgagaagctgtccggtgaagagctgattccgttttgcacgctgctgctggtggccggaaatgaaaccactacaaacctgatttcaaatgcgatgtacagcatattagaaacgccaggcgtttacgaggaactgcgcagccatcctgaactgatgcctcaggcagtggaggaagccttgcgtttcagagcgcccgccccggttttgaggcgcattgccaagcgggatacggagatcggggggcacctgattaaagaaggtgatatggttttggcgtttgtggcatcggcaaatcgtgatgaagcgaagtttgacaggccgcacatgtttgatatccgccgccatcccaacccgcatattgcgtttggccatggcatccatttttgccttggggctccgcttgcccgtcttgaagcaaatatcgcgttaacgtctttgatttctgcttttcctcatatggagtgcgtcagtatcactccgattgaaaacagtgtgatatacggattaaagagcttccgtgtgaaaatgtaatagataaggagactggagattcatgaaaaagtaccatatttcgatgatcaatatcccggcatacggacatgtcaatcctacgcttgctttagtagagaagctttgtgagaaagggcaccgtgtcacgtacgcgacgactgaggagtttgcgcccgctgttcagcaagccggtggagaagcattgctctatcatacatccttgaatattgatcctaagcaaatcagggagatgatggaaaagaatgacgcgcccctcagccttttgaaagaatcactcagcattctgccgcagcttgaggagttatataagggtgatcagcctgatctgatcatctatgactttgttgcgctggctggtaaattgtttgctgaaaagcttaatgttccggtcattaagctctgttcgtcatatgcccaaaatgaatcctttcagttaggaaatgaagacatgctgaaaaaaataagagaagcagaggctgaatttaaagcctacttggagcaagagaagttgccggctgtttcatttgaacagttagctgtgccggaagcattaaatattgtctttatgccgaagtcttttcagattcagcatgagacgttcgatgaccgtttctgttttgtcggcccctctctcggagaacggaaggaaaaagaaagcttgttgattgacaaggatgatcgcccgcttatgctgatttctttgggtacggcgtttaacgcatggccggaattttacaagatgtgcatcaaggcatttcgggattcttcatggcaagtgatcatgtcggttgggaaaacgattgatccagaaagcttggaggatattcctgctaactttaccattcgccaaagtgtgccgcagcttgaggtgttagagaaagctgatttgttcatctctcatggcgggatgaacagtacgatggaagcgatgaacgcaggtgtgccgcttgtcgtcattccgcaaatgtacgagcaagagctcactgcaaatcgggttgatgaattaggccttggcgtttatttgccgaaagaggaagtgaatgtttccagcctgcaggaagcggttcaggctgtatccagtgatcaagagttgctcagccgcgtcaagaatatgcaaaaggatgtaaaagaagctggcggagcggagcgtgcggcagctgagattgaagcgtttatgaaaaaatccgctgtcccgcagtaaaaacataaaaaccgaaatcaatttgatttcggttttctgtttaaatattttttttcatcccgcatctccggcattctctaagaaattttccgccttttacagagcttttgaacagtgtgtaatcacagttgtcgcagcgcccgctgcgggcgtccggatattcattgaattcgtaaacaatcgatgtatcgtagccttttgtttcatattcttctttttttgtttccatgtcgatcctccgttacaagacgtgtctgctgtttatcttacagcaagcttccggcgtattcaatggattttaggagtttgggtttatcttgatttctcccttggtttgcgccaaaatagctttaataagcttgtatacataaaaagcctatgcaaagaggagaggaaacgggtatgggaaaagggttacttggaaaacgcgtggcaatcggtggctcacgaaaaacggaagaaatcagtacaatcattgaaaaacagggcggaatacctgtcatccggcctctccaaggtacagtttacttagcagagaagcaggtggagccggatttgcggacgtttgcggaagaaaaagctgactgggtcattttcacgacaggcatcgggctggagactcttgtcgatatggcagagaaaattggactgaaagatgagtttctgcaggccatttgccaagcgaaagcggcatgccggggatacaaaacgctgtctgcgctgaaaaagcttggaatcacaccggaagcttcggatgaagacgggacaacaagaggcttaatccgttctttggagcctcacgacttttcaggaaaaacagtcctggtgcagcttcatggcgaaaaagcgtcggctctcatggcatttcttgaagaaaaaggcgcgtctgtcctgccgattctgccttatcagcacatcccgccggaggaggaaacggtggagcgattatgccgagagctgatgaacggtgagatcgatgccgtttgttttacaacggccattcaggttcgttccctgtttgattttgctaaggggcgaggttatatcaatgaagtgaagaaggtattcgaagaacgcgccatcgcagctgctgtcggaaaagtgactgctgaagcactgcgggaagagggcattacgagactgcttgcgccagagattgagcggatgggtgcaatgattgttgagctggccaagtattatgaagaaaaggaataacaagtacaaaaagccgcttttccctcggaaagcggcttttgtctgtcattcattctgcttcagctgctgatgaacggtgaataatgatgggtatgtcagcacgcttaagattacacaagtcagcgcggctgaggccatcgttgtaaacacgattaagagctgaaagcgtactgcctgaatcgggtccgcgccggctagaatctggccagtcatcatgccgggaagctggacaagacccagtgttttctggctttcgagcgtcgggatcatactcattttcatcgctgaggtaagaatgcgctgtatggattgcttcggtgtgccgccaagtgacaatattaattgaatttcttctttgcgaacgccgacttctgagttaagccggtttagaaacaaacttgagagcaccatcgaatttccgatgaccatcccgctgatcggaatgacatatcgtgccgtaagcggaatgatatgaagagacagcagaattccctgcgtcacaatttctacgattgctaacgcggcaaacaccctccaaaacgaaccgatagtatttttctttcgcttgatgacattttgcgccgccaccgcgagcattaacagcaccatcagcaggataaaaacagggtggtctccgcgaaaaatcagcgacaaaacataaccgatgataagcagctgcaccgcggcccggatggtggcgatgatcatgtctttttctacaccggctttaaaggattttgataaaaacaaggcgatcaaaacaaagatcatcgttaaagagagagaaaggtaatccattaccgagtgcctcccttcaaaaattctttcgctgcttcatgctgcggagcggagaaaaatgtttcggtttcagcgatttcaagcagccggccatctgccataaaccaaatggtatcggctattcgttttgcctgctccatattatgagtgacccacatgactgtccattttttctcttgatgctgacgtttgatcagttcttcaatctcaagagcagaaaccgggtccaaggccgatgtgatttcgtccaacaatagaatggaggaaggatttgagagcgttctggccagtgacagtctttgccgctgcccgcccgataagtctctggcgcttctgtctaacagctctggcggcagccctgcaagagaagccagcttttcaggagagtacagctgggattgatgcagcctttgtacaagacttaaattgtcacgcactgtcccgtcgagcacgggagccgattgaaacgcgagggctgccgttcgcctcagctcattgacattccattctctgacttcctttccatatatgttgacttcgccgctgtcaggcgttctcattaaattacacatagaaaggagggtgcttttgcctgagccggaagggcctaaaacggctacgattgcgccctgttgaatgtctccggtgacatcctgcagcacatcataggtttgtccatcttgtttatagctttttctgactgatctgaaggagatggctggtatgttttgtgtttgatcgtttgcttccattacaataatcacctttcaatataagtaggctgacattatatttaactataacgtgaaacagattccttttggtagcacaaataaaggagaacaggctttcacccattctcctgcagatgctacgcagtcagatttgactgtgctttctttttcggttttctcggctgtgaagcgaaggtatgtaacatcatccctgctattataatgaataaaccggcaaatgataaaagagatgggaaaacgcctgacagcagaacaatttcaccaagcagcgcgaaaatcacttcaccggattgagtggcttcaacagctgcgagtttttgaggattgtctcttaccatatcagtggcccagaaaaataaaatcgtcgcaatgatgcctgagctgatggcaacgataaggattgaacggtttgacttgctgtggaaggccatctgaccaccagccgtaagctgctaatataagccagaatggaaggcttgccaatgtcattccaagcacgcgctgaaatgtatcaagccggcctccgtattcttcgagcattctcctgtttcctaacggataggcaaaagccgcaatgacaaccggcagcacactgaaaagaagagtgaagccaatattccgataacgatagctttcatgatatccctcattctggcattatttttttatactatacaattcggtatcatgcagatcaatggaatcatgagaaaaacatcatgttttgagaaccgctatgtgtggaagacaaaaaagggaggtgaaattgatggaaaaagagacacagacatacttctttccggatgacggcaggattccgaatcaccctgattttccgctcgtggtgtatcaaaacgcgcttaaggacaccggactggcagagcggatcgtcatccggcatggctggtcaaacagctggtcagggagtgtttttccataccatcattatcacagcaatacgcatgaagtcctgattgcccttaggggagaggctgtgattcagtttgggggagaaaaaggggctgccatccctttcaaatcaggcgacgcagtcgtgattccagccggagtcggacataaaaagctcagctcaagccccgattttactgtccttggcgcctatcccggtggcgttcagtatgatatgaagacggggaaaccgaatgagcgggaggaagcgctcaaacagattaagcaggcggcgttgccggcgaatgatccgatcacaggaaaaagagagcctctattggaaatatgggtaaagtgaaggggagaaattgctggattgtcaataactagtgccgcagaaacgatatgacatgagctccatataaattaatttcataatcgaagcaattcacgttcaaattttgttcaaaaagtgttatcatatagaaggtaatcgaattggagttttttgtgtttgctattttcagagagagtaaaggattttgacttattcaattgtttatttttagataaaaataatactgaatatggcaagatgaaaaactgggtagtaaacatttatttttgtaaatgattgtgcacgaattcacaatccttattcttatgccttaaaagcgtgagacagggagaggcactaccctttccaaaaaaatcagcaaactgcttatagtaaaggagaattggatatgccagaaacaatcgatcaaacaaatgcgtctgtcagccaaagccagcaagatcttattgatcagctattaaagccagaagttcaagaatcattgactgttttagttgaccagcttccgaagctgactgagttagtgaatattttaacgaagtcttatgatttcgctcagtctgtagcgactgacgaagtgttaaagagcgacacagtcggtgcgatcactgaaattctcgagcctgtaaaagaaacagcgaaagaagtagctgcgactgcgatcgaagcaaaagaccgcgcggaagcaagcaacgaaacaattggacttttcggccttcttcgcatgctgaaagatcctcaagctcaaaagctgttccgttttgctaacagctaccttgaagtcatgaacgaacgcgaaaaccaaaaataatctcagattcaaattgatataaaggacggaggatatacgatgtcaaaacatattgtcattctaggcgctggttatggcggagttctttctgctctaacagttcgcaaacattacacaaaagaacaagcacgcgtgacagtggtaaacaaataccctactcaccaaatcattacggaattacaccgccttgctgcaggcaacgtgtctgaaaaagcggttgcaatgccattagaaaaacttttcaaaggcaaagacattgatcttaaaattgcggaagtaagctctttctctgttgataaaaaagaagttgtgcttgctgacggttctacattaacttacgatgcgcttgttgtaggtcttggttctgtaacggcttacttcggcatcccaggtcttgaagaaaacagcatggtattgaaatctgctgctgatgcgaacaaagtctttcaacatgttgaagatcgtgtgcgcgagtactctaaaacgaaaaacgaagcagatgcaacaatccttatcggcggcggcggcttaacaggtgttgagcttgttggtgagcttgctgacatcatgccgaaccttgcgaaaaaatacggcgtggaccataaagaaatcaaattgaaacttgttgaagcaggtccgaaaatccttcctgttcttccggatgatcttatcgagcgtgcgactgcaagccttgaaaaacgcggcgttgagttcttaacaggtcttcctgttacaaatgtagaaggaaacgtaattgatctgaaagacggatctaaagttgttgccaacacatttgtttggactggcggcgtacaaggtaacccattagtcggtgaatcaggtctagaagtgaaccgcggacgcgcgactgtaaatgacttcctgcaatctacatctcatgaagatgtattcgttgctggagacagcgcagtttacttcggtgcagacggccgtccatacccgccaactgcacaaatcgcatggcaaatgggtgagctgatcggttacaacctattcgcttacctggaaggcaaaacgcttgaaacattcaagccagtaaactctggtacacttgcaagccttggacgcaaagacgcggttgccatcattggtgcaaattctacaccgcttaaaggtcttcctgcttccttgatgaaagaagcaagtaacgtacgctacttaacacacattaaaggacttttcagcctggcttactaatcctttttatgaatttgacattgccaaaagcgttcctttccgggtgctttctggcaatgtctttttttgtttatatgctaacgttaacatttcattttcaaaaaagagattgatcccagaggaatataaaggtaaaatagatacaaatcaaaatgttaacgttaacattttgaaatagaatgaaagacggtgaggacatggaacccttcatgggcgaaaactttttattgaaaaatgaaaccgctgtcagcctctatcataattatgcgaaagacatgccaattattgattaccactgccacttaagtccgaaagaaatctatgaaaataagacatttcaaaacatcacggaagcctggctgtatggtgaccattataaatggcgcatcatgagagccaatggaattgaggagacatacatcaccggagatgcgcctgatgaggagaaatttatggcttgggcgaaaaccgtgccgatggcgattggcaatccactctacaattggactcacttagaattgcagcgtttttttggcatttatgagattttaaacgagaagtccgggccggctatatggaaacggacaaatgaactgctcaaaggggagggcttcggggcaagggatttaatcgtgaaatcaaatgtaaaggttgtgtgcaccacggatgaccctgtcgattctcttgaataccatctattattaagagaagacaaagactttcctgtcagcgtgctgcctggatttcggccggataaaggacttgagatcaatcgtgaaggctttactgagtgggtgcaggcgcttgaagatgccgccgccatatccattacaacctatggtgagtttttaaaggcgttggaaaaacgagtgcgattcttccactcagccggcggcagagtttctgatcacgcgatagattcaatggtatttgccgaaacaacaaaagaagaagctggacggattttttctgacagattacaaggaacagaggtttcttatgaagatgagaagaaatttaagacatatacgcttcagtttctttgcggtttgtatgcggagctcgattgggcgatgcagtttcatatcaacgctttaagaaacacaaatacaaaaatgatgaaaaggctcggacctgatacaggctatgattcaatgaacgatgaagaaattgccaagcctttatacaagctgctgaactcagttgagatgaagaaccagctgccgaaaacgattttatattcactgaatccaaatgataactatgtcatcgccagcttgatcaacagttttcaggacagtattaccccgggaaaaatacaattcggcacagcctggtggtttaacgatactaaagacgggatgctcgatcaaatgaaagcgttatcaaatgttggccttttcagccgttttatcggcatgctcaccgattccagaagctttctttcgtatacgcgtcacgaatatttcaggcggatcgtctgcaatttgattggagaatgggtggaaaacggcgaagtgccgcgcgatatggaacttctgggaagcatcgttcaggggatttgctatgacaatgcgaaacactactttcaatttcaagaagagaaagcaaacgtgtaacaaagtatccgctcagtatccctgagcggatcactatccgaaaattcttaagacacagaggtggaacatgcgaactgaactggcaaataaggttgtgtcggtcgaaacggaaaaaaggctttcattgaaagagaaaatgtcctatggttttggtgattttggcaatggttttatgtttgatctcggccagatttatttattgaagtatttcactgatgtagcgggaatccccgctgcgatggccggcggcatttttttagtcagtaagctgtttgcagcgataacagatccaattgtcggctcatcaatcgattatcgcaaaaacatcggcaaacgggggaaattcaggccttatctattaatcggcagcatcgtgcttgcggtgcttactgttcttatttttctgtctcccaatgtatcaacgaccggaaaactgatttatgcatatgcatcctatatgatttggggcatcggctattcgtttgtgaatattccgtacggctcattaggggcagcgatgactcaaaattctgaggaccggacctccatttcgacgttccgccaaatcggatcacttggcgccttgtttatcacaagtgttgccgtgatgccgctgctcatcaagtttgataatccgaaggtcggctacccggtggtcatgggcttgttcgctgcactcggtgtgctttggttttatatttgctaccgcaactgcaaagagcgcattgtcatatcggaagcacccaaagaaaaattaacactctcatctgtcgtcaaaacatttattacaaataaaccgctgttaacccttgtcctgatgacggttttttcaatttccgcatacaacattaaatccgccatgctcgtctatttcgcacaatataacctgggcaatgttgaattaatggcttatatgaacttcataattatcggttcttcctttttgggcgtcgtattccttccaaagctcgtcaagatgtttggaaagaaacgaacggcaatgatcggcttcggcatcagtgtggccgcggatctgatcaactttatgcttccatctaacgtttatgtgtttacaattctcgccagtatcgcctttattggaatcagtatcccaaatggcatcacgtgggctcttgtctccgatattatcgactatggcgaatggaaatccggtgaacggaaggaagcaacgacatattcacttttcaatttctccagaaagcttgctcaatctttgtctggctttctctcggggatcggtttggggattatcggctatgttccgaatgcagtccagacagcacaggcgctgattggcatcaaagcgctgcttcttctgtatccggccattgctttggcattagcgatgatcattatcggctttctttataaactcacagaccagcagcatgctcagatcgttcaggatcttcatcaaaagtactgacaatataatataaagaatatttaaaataatttgtaaataaaatgtgtttgtaggggtttcgctaggggagtgcccaaaaaactgaaaaggaaggaggcacttgtttgaaaacgataacaattgcagctgaagaagcaaagggactcgttcgacaaaagctggccggtgccggtttgaatgaacgagatgctgaaaaagtagcagatgttctcgtgcacgctgatttgcgcaatgtacattcgcatggcgtgctgcgcacagaacactatgtgaacaggcttttagcgggagggatcaatcctggggcacagcctgtttttaaagaaacggggcctgtgaccggggtgcttgacggagacgatggtttcggtcatgtgaattgcgacatggcgatggaccatgcaattgacatggcgaagaaaaaaggagtcggcatggtcacggccgtaaacagcagccattgcggagcgctaagctattttgtgcaaaaagcggctgacgaaaagctgctcggaatggcaatgacgcatacagacagtatcgttgtcccgtttggggggaggactccttttttagggacaaacccgattgcttacggtgttccggctaagcataaaaaaccgtttatcctagatatggcgacatccaaagtggcttttgggaagattctgcaggcccgtgaagagggcaaagaaattcctgaaggatggggagtcgatgaaaacggagaagcagtaactgatcctgacaaggtcgtctcactttcaacattcggcggcccgaaaggctatggactatcgattgtggtggatgtattttcaggattgctggcgggcgcggcttttggccctcatattgccaaaatgtacagcggccttgatcaaaaaagaaagctggggcattacgtttgcgcgatcaatccagccttttttactgactgggatacgtttttagagcagatggatgccatgattgatgaactgcagcaatcaccgccggctgttggattcgaaagagtgtatgtgcccggcgagatcgagcagctgcatgaagtaagaaataagaaaaacggaatttctatcgcccggagcgtgtatgaattcttaaaaagcaggtgagtaaaatgaaagcggttcaagtgcgaaaagcgtatgatctggtgacagcggaggtgaagaagccagttctttcaaaggatgatgaagtgctcgtgaaagtcaagcgagtcggcatttgcggttcagacatgcacatttatcatggaacgaatccgctcgctaccctcccgagagttatcggacacgaggtaactggacaagtggaggcagttggtgcgaatgtacagagcctaaaacccggtgatcatgtggtgattgagccgatttcttattgcggatcgtgctatgcctgccgcaaagggcggccgaatgtttgcgccaagctttctgtatttggcgtacatgaggacggaggcatgcgggaatatattgtgcttccggaaaggcagcttcacgcggtctcaaaggacttgccttgggaggaagcagtcatggccgagccttatacgataggcgcccaggcagtgtggagaggccaggtggaaaaaggtgataccgtcttgatccagggagcggggcccatcgggatctgtgtgttaaaaatggcaaagctggcgggcgctgctgtcatgatgactgacttgaacaacgagcggctggcatttgcgaaagaaaacggcgccgatgctgttgtaaatgtccaagcagaaaatgttgccgagcgggtccttgaatggactgggaatgaaggagcaaacgtggtcattgatgctgtttgcctgccggagacatttgcgctttcaattgaggccgtatcaccggcgggacatgtggttgtgcttggatttgatgaaagagcggctcagatttctcagctgccgattacaaaaaaagaagtcacgataaccggatcccgattgcagaccaatcagtttccaaaagtagtagagcttttgaatagaggccagttagtgcataacgggctggtgacccatacattttcagttgatgacgttcatcatgcatttcagtttattaaggagcatccagatcaggtgcggaaagccgtcatcacgtttgattaaatgactgaatccggaggtgcgagcatgaatatgacattccgatggtatggacgaggcaacgatacagtcacacttgaacacgtgaagcaaattcccggtgtcaaaggcatcgtttgggctctccatcaaaagcccgtcggcgacgtgtgggaaaaagaagaaatcagagccgagactgaatatattcaatcctatggttttcatgctgaagttgtagaaagcgtgaatgttcacgaagcgattaaacttgggaacgaagaacgcggccggtatattgaaaactacaagcaaacgatccgcaaccttgccggatttggcgtgaaagtgatctgctataattttatgccggtttttgactggacacgcacggacatgttcaagccgctagaagatggatcgaccgctctgttttttgaaaaggccaaggtggaaagccttgatcctcaagagctgattcggacggtggaggaagcatccgacatgacgctgccggggtgggagcccgaaaaattggctcggatcaaagagctttttgctgcctacagaacggtcgatgaagaaaagttatgggacaatttatcattctttttgcaggaaattcttcctgttgctgaggcctatggtgttcaaatggccattcatccggatgacccgccgtggtcgattttcggactgccgcgcattatcacaggagaggcaagctataagaagctgcgggcgatatcagattcaccgtctaattgtatcaccctttgtacaggttcaatgggagccaatcccgctaacgacatggtggagatcgctaaaacgtatgccggcatcgctccattttcacatattcgcaatgtgaaaatttatgagaatggcgattttattgaaacatctcatttaacaaaggatggttcgatcaacattcaaggcgtgatggaagaactgcataagcaggattacgaaggatatgtcagaccggatcatgggcgccatctttggggcgagcaatgccgcccgggatatggcttatacgatcgggcacttggcatcatgtatttgaacgggctgtgggacgcctatggagtaatggcaaaaaaagaggtgggcgtatgatcccgctgcatgagaacctggctggtaaaacggctgtcatcactggcggcagcggcgtgctttgctctgcgatggcccgggagctagcccgtcatggcatgaaggtggcgatattgaatcggacggctgaaaaaggccaagcggtcgtgaaggagataacggcggctggcggcacagcgtgcgctgttgctacggatgtgctggacaggatgtcactggaacgggcaaaggaagacatccttggccaatttggcgctgttgatctgttaattaacggggctggcggcaatcatcctgacgcgataaccgatgtggagacatatgaagaagcgggagaaggccaatctttttttgatatggatgagaggggctttctaactgtattctccaccaatttcaccggtgcgtttctggcctcgcaagtgtttggaaaagagctgctgaaagccgattcaccggcgatcatcaacctttcttccatgagtgcttattcacctatgacgaaggttccggcatacagtgccgcgaaagcatccatcaataattttacgatgtggatggctgttcattttgctgaaaccgggctgcgggtcaatgcgattgccccaggcttctttctgacaaaacaaaatcatgatctgctgatcaaccaagacggaacgttcaccagccgatctcacaaaattattgcgggaacaccgatgaagcgcttcggaaaacccgaggatttgctcggtacgcttctttggctggcggatgaatcctattccggttttgtcactgggatcaccgttcctgtcgatggaggatttatggcttattcaggtgtgtaacgaaagcggtgcaacagaaactgaaccaacataggggtgaggttgagatgttttcaaaagataagcttcccgttatcctttttttgttcctggcaggggtgattaattacctggatcgctcggcgctttccattgcagctccttttattcaggatgatctcacattgtctgccacgcaaatgggcttgattttcagcagtttttcgattggttatgcgatttttaactttcttgggggcgtggcatccgaccgctatggggcaaagctgaccttgtttgtcgcgatggttgtttggtcgctgtttagcggagcagtcgccctcgcttttggctttgtcagcctgctgattatacgcattctcttcggaatgggagaaggcccgctttcggcgaccatcaacaaaatggtgaacaactggttcccgccgacccagcgggcgtctgttatcggtgtaaccaacagcggcacgccgctcgggggagccatttccggcccgatagtcggcatgatcgcagtggcgttcagctggaaggtatccttcgttctcattatgattattggattgatatgggcagtgctctggttcaagtttgtcaaagaaaagccgcaagagacgatcaaggaagcaccggcaataaaagcagaaacgtctcccggagaaaaaattccgctcaccttttacctgaagcaaaaaacggtcctgttcacggcgttcgcttttttcgcttacaactacatcctcttcttctttttgacgtggtttccgagctatcttgtcgacgagcggggattaagtgttgaatcgatgagtgtcatcacggtcataccgtggattttaggatttatcgggctggctgcagggggatttgtttctgactatgtgtacaaaaaaacggcccgaaaaggtgtgctgttctcgcgcaaggttgtgcttgtcacgtgtttgttttcatcagctgtcctgattggttttgccgggcttgtggcaacgactgcgggggctgtcactcttgtcgctctgtcagtgttctttctttatttgaccggtgctatctattgggctgtcattcaagatgtggttgatcaaaacaatgtcggttctgttggcggcttcatgcatttcctcgccaacacggcaggaattatcggcccggctttaaccggatttattgttgaccaaacaggcacgttttctggagcatttttgcttgccggagggctggctgtcttcgcttcacttgctgtgattcgttttgtccgtccaatcatcggcaagacagcgggaacagaagcggaaaaccctgtgtcttattaatctggaaatacagtgggagaggcggtatgtttgatgatacaatatacagtaaataatcgcagccggtatgataaggaagggaattagatggtaaccataaaagatatcgcaaaactcgcaaacgtatcccacacaaccgtttccagagcactcaacaacagcccttacatcaaagaacatacgaagaaaaaaatattagagctagcagagcagctcaactatacaccaaatgtaaatgcgaaaagtctggcgatgcaaaagtcgcatacgatcgggcttttctttacaagcattacaaacggaacctcacacagcttctttgcagacacaatcaaaggcgtcaatcaagccataagtgaggattacaatctgtatgtgcgcggcattgatgatctgaaaaactatgactccgttacaccgatgagatatgacggcatcattttaatgagccaaagtgacattgataattcttttatttaccatattcgcgaaaaaaacattccgcttgtcgtgctgaatcgtgatattgatgatcgcaccatcacgaatattttgtccaatgacaaggaaggctctcaagaagctgtagaatacttcattcagtccggacatcaagacatcgccatcatcgaggggatcgaaggctttaaatcctctcagcagcgaaaggaaggctacttatctgcactgattcaacatcatattccgatcaagcatgaatacagtgtcaaaggacagtacgatatggaaagcggctttcaagcgatggagcggctgctggcactgccgaatcctccaaccgctgttttttgttcgaatgatgacatggcaatcggagcgatgaatgcgatattcgcaaagggcctgcgcgtccctgatgatatttcggtgatcgggtttgatgatattgggttttcacagtacatcacgccaaggctttcaacagtaaagcgcccagtggagaaaatcagcgtgcttggcgcgcaaaaactcttgtctctgatcagcaagcccgaaacaaaagcagaaaaaatcttggaaaacacagaatttatggtgcgtgattcagtcagacgattgacgacgtgatgtcccgtttttcagcgggcattctttatacagaaaaatgttaacgtgtgcataaaaagagggaggcaataagggtgcagaagctgaataaaaatgtgtacgatcactatactcagtatccagaaaaaattctccaattcggagaaggaaactttcttcggggatttatcgattggcagattgatcaattgaatcaacacactgattttaatgggagtgtggcggttgttcagccaaggggttcagaaaaaatcaaacgattaaatgagcaagatggattatatacgctttttttacaaggaatgaaagatggagaagcggtaaacgagcatatgattatcaactcaatcagccggggaattgacctgttttctgattatgaagcatacaaagaattggcatcaagcgaagagcttcggtttatcatctccaacaccactgaggctgggattgtatgtgatgaaaaagatcgtttagaggataggccgcaaaaaacattccctgggaaattaactgcatttctctacttccgctatcaggcttttaaaggagatcagacaaaagggtgtgtcctaatcccatgtgagctgatcgagaagaacggtgaaaagctgaaggaaacggttattcattatgcaggtctgtggaagcttgaggaaggatttacacagtggattcatgaggccaatacgttttgtaatagtttagtagaccggattgttccgggttttcccgtcgacagcattgatgagatcacggcagatcttggctatcaggatgatttgatagttgtgggagagcaatattatttatgggttatcgaggggcctgattggattggaaaagaacttccctttgcggctgcagggctgcatacaaagatcgtcagcgacctcaccccataccggactaaaaaagtaagaattttaaatggcgctcatacagcaatgacgccagtggctttattatacggcttgaagactgttagggatgcagtggagcatccggaagtggggcgatttataagagagctgattgatgacgaaattcttcctgttttaaaaatggaaggtctttctcagtatgctgacgatgtgctgaaccgttttaaaaacccgtatattaagcattacctggaaagcattgcattgaacgccatttccaaattcaaaacgagaaacctgccgactcttaaggaatatgctgaacaaaagggacagcttcctgaacgcttggtgttttctttcagcgctcttctgtatttttatcataataatgagacattgcaggatgatccggcagtgcttcaatttttcaaagaggtttggtgtcaggaggatgacgacatgcttcggattgcatcaagagtgttaggcgaacagcggctgtggggggcagatctcaatgagataccgaagctgactgatagagtcgctgtttacttgaatcatattcatgagctgggcatgcagagggctcttgaacaatactgcatacaagggggagaggtacgttgaagtcgtttataaagattcataagcaagataatgtccttctcgctctgcgggatattcaaaagggagagaggctgtatgcggacggcgtgtcgcttgaagtaaaggatgatataaaaagaggccacaagattgcattgcagcctattaaagaaaatgacagcatcatcaagtacgggtttccaattgggcatgcaacacaagatatctcgatcggagagcatattcatgtccataatacgaaaacaaacctgtctgatatccaatcatacagctatacaccgagatttgatgaaaatccgtattctaatgagaaccggacgtttaaaggttttagaagagaaaacggagatgcgggtgtacggaatgaattgtggattgtcccaactgtcggctgtgtcaatggaatagcagaaaaaatgctgcagcgttttgtcagagaaacaggggatatcactccatttgataacgtactggtgttaaagcatcaatacggatgctcgcagcttggcgacgatcatgaaaatacgaagcaaatcctgctgaatgctattcgccatccaaatgccggcggcgtcttggtgttagggcttggctgtgaaaacaatgagctggcaagaatgaaggaagcactgcaagatgtgaacttgaagcgggtgaagtttctggaatcccagtcggtgaccgacgaaatggaggcaggcgttgctttgctgaaggaaattcatgaagcggccaaaggagataagagagaagacattccgctgtctgaactgaagatcgggctgaaatgcggaggttcggacggtttttccggcataaccgcaaacccgctgcttggacgtttttcagattatctcattgcacagggagggagtactgtgctgacggaagtaccggaaatgttcggagcagaaaccatcctgatgcagcggtctgccaatgaagaagtgtttcataagatagtcgatttaatcaatgatttcaaacaatactttattaaacatgatcagccggtgtacgaaaatccctcaccgggcaacaaagcgggcggcatttctacacttgaggataaatcgctgggctgtacgcaaaaagcggggatttctcctgtcacggatgtcttgaaatacggtgaagtgctcaagacaaaaggactgacgcttttgagcgcgccaggcaatgatttgatcgcctcctccgcattggctgctgccggctgtcaaattgtcctctttacaacgggaagaggcacgccgtttggcacctttgtcccgacggtgaaagtagcgacaaacaccgagctgtatgaggcgaagccgcattggattgattttaacgcaggccttttagcagaggatgatgttcatgaggaatatgtgctgcgtgagtttatccactatatgattgaggtggcaagcggccagcttgtgaaccatgaaaaaaatgatttcagagaactcgccatttttaaatcgggtgtgacgctataataagaaaaggctatccttcaagcggatagccttcttcattaaatcaattttaaaccgctgactaaaataatggacgccataataaattgcagtggacgcggggagaatcgaggcgaaagatggcttccgatcagcacgccgggaattgaaccaatgagcagattagctgccagcatgtaatccacgcttccgaagcttgcgttcaaaatgcctgctgccgtaacaagaagaaatgcatgcgcgatatcggttccgacaatctgtgacgctttcatgttaaataagtaaatcatggcgattgcaaataatgagccggaaccgattgatgttaatccgacgataaacccaaacacaacaccaataagaattgtcagcgccctcttattttcaagcggcatcagctgccagcggttggggcgaagttttctgtccaaaaacaaacgaacgatgattgaaatggcaaccagcgttaacacatatcctagagcgtgcttaataatttcttcctgatgctggtgaaaggcggggaacaaatgcaatatgccaatggctagcgaagcactcggaatactgccgatggccaagtattttaccaatttaaagttaatcgttttctgccgccaatgggaggcaacgccaaacagctttgtgatcgagttatatacaagatctgtaccgaccgcgatggaaggattaattccaagcacaattaaaaggggagttaataaggccgctccacctactcccgtcaatccgactaaggctccgacaaacaaacccatcaatatgatgcttacactcatgataaaggcctcctgaaaacccgactatttttatcagattatatatgattaggacgcgttaatcaattaaattttttgaatttttgcacgtcagctgcttggaattttggtatgctcaatatctctattcatttgccctataatgagtgtctggacgaaatcgagaagtactaaaggcgcaaaaaaaagatacctcttaacaggtatcttttttcttgtttacgctacatgcgctgctgatagaaaggaagctcagtgtggcccatttcccgcacatacacgaacaggttgcctttatggtgaatttcatgctccattgcaagctgaagcagcgcgcggcctgtgacttttctgccgaaagcggatgtcagatcaatttctctgtccagctgctcttcagtcagctgttcaaggatagcggccgttttttctgtatatgtttttgccagaacattgagatctgtttctgtttcttcctgcttgttttgaaatggtgaggcattgccttccttaatgacatttgcgaacaagtggaaagacgtaagaatgtgtttgaccagctcttctgctgacattgatgtttctgccggtttgtagctgtaatggtctttgctgattttttcggcaagctcattggtcacgtttcgatgggataaaaaatggctgacaatttgattggattggctcattatgatctcctccatatgtaaaaataaatggtgcaatgaaatcctatatcaacggttatgaattcacaagtaatatgctgtgggatgaaacaaaatgctatgtcaatcgtatatataacgttcacaaaacatgaaatggagtataaacatgactaatatacctttcatttatcagtacgaagaaaaagagaatgaaagagctgcggcgggctacggcactttcggttaccttatcacacggattgaagaaacgctttatgatcaatacggtgtattctatgagctctatgccagtgatgatccaaatacggaatactgggagcttcttgtagaagatgtccgcagcggttcattggagcctgagcatgtggcatatatatttgaaaagcttgaaaagaaaacctttgcttacgatgaagatgagaaagaaccggattataccgtccataagtctataagaaacagtgtatacgcatatcctgaaaagggagttgcttttgccagaattccatattttcaagatgggagcattatgagttttgattgtctgtttgcggttaacgatgaaaagatgcgtgcatttctggagggagtcagaccgcgtctttgggaaaaaagcaagcgaaaagtgaccgtgtttacggatggagatggagggacttcaagagagcaggaagccattgtcagagaggttcagcggagtcaagtcatcatgaatccgctattgaaaaaggagatatacagatcaattgatcagttttttcatagtgataaatcgttttatcaaacatatgacatcccttacaagcgcggcattctgttatatggacctcctggaaacggaaagacgacgttagtgaagtcgatcgcaggcagtatcgatgcacctgttgcttattggcaaattactgaatttacgtcgagcgagacaatagaagaagtctttcaggcagcgagacgcctcgctcctgcagttctggtcatcgaggatatagattcgatgccggaagatgtgcggtccttttttctcaatacgctggacggcgcgacatcaaaagaggggctatttctcatcggtacgacaaactatcccgaagagatcgatccaggtttgatgaatcgtgcagggcgatttgaccgtgcctatgaaatcgggcttccggatgaagagctgcggctggaatatatgaaaatgagaggctttggcatctttttgagtgaaggagaaataaaaaacgccgcaaaacttacagaaggcttttcctttgcacagctgggagaattatatgtatcttcagcccttcaatggcaccaagaagggaatcatcatattgaaaccatggtgaaagacatgacaggagagcaaagaaaaagccagcggggaagctggatggaaagaaacaaagtcggttttcactaaaagaaagcacgggtgtttgaaaaacccgtgcttttttgttgcggttagccgaaattcgacaattgcggttattttgcgttcttctttttcttgcaaatatgataaaatatgacatatctcgggtaattcaaaaagggggattaattgaggatgaagcagacgattccgtcctcttatgtcgggcttaaaattaatgaatggtatactcatatccggcagttccacgtcgctgaagccgaacgggtcaagctcgaagtagaaagagaaattgaggatatggaagaagaccaagatttgctgctgtattattctttaatggagttcaggcatcgtgtcatgctggattacattaagccttttggagaggacacgtcgcagctagagttttcagaattattagaagacatcgaagggaatcagtacaagctgacagggcttctcgaatattactttaatttttttcgaggaatgtatgaatttaagcagaaaatgtttgtcagtgccatgatgtactataaacgggcagaaaagaatcttgccctcgtctcggatgatattgagaaagccgagtttgcttttaaaatggccgagattttttacaatttaaaacaaacctatgtttcgatgagctacgccgttcaggcattagaaacataccaaatgtatgaaacgtacaccgtccgcagaatccaatgtgaattcgttattgcaggtaattatgatgatatgcagtatccagaaagagcattgccccacttagaactggctttagatcttgcaaagaaagaaggcaatccccgcctgatcagttccgccctatataatctcggaaactgctatgagaaaatgggtgaactgcaaaaggcagccgaatactttgagaaatctgtttctatttgcaagtcggaaaagttcgataatcttccgcattctatctactctttaacacaagttctgtataaacaaaaaaatgacgccgaagcgcaaaaaaagtatcgtgaaggattggaaatcgcccgtcaatacagtgatgaattatttgtggagctttttcaatttttacatgcgttatacggaaaaaacattgacacagaatcggtctcacacacctttcaatttcttgaagaacatatgctgtatccttatattgaagagctggcgcatgatgctgcccaattctatatagaaaacggacagcccgaaaaagcactttcattttatgagaaaatggtgcacgcacaaaaacaaatccagagaggagattgtttatatgaaatctaaatggatgtcaggtttgttgctcgttgcggtcgggttcagctttactcaggtgatggttcatgcaggtgaaacagcaaacacagaagggaaaacatttcatattgcggcacgcaatcaaacatgatgcataaaaaagacccttaagggtcttttttatttcttcagcttccattcttttatcgtcagctcaggagatccacttgccaccagcggatccgcatgcccgatttccgctgcctcttccagtgaacctgcttcgatgacatacgctccgcctgtggcgtcgctgaatggtccaaacatttttaaacgcttttctgcctgtaaacgatccagaaattcatagtgcccagccacatgctcctgattaaatttctccgttctcattgtcagcattaaatatgtatacatattcagaccctccatgaacttcagtttaacacatttatccatattacggtgatagatgatatgagcttttcgtcctacgaatgccacctatttatgaaaaaagaaaaggagagatgataggtgagcattccagtaaagaaaaatttggtttctgaggcgaaatacgcgttgaagtgtccgaatgcaatgtccgctgaatacattaccattcacaacacggcaaacgatgcgtcagcggccaatgaaatcagctatatgatcgggaacacaagctcgacaagctttcattttgcggtcgatgatcaagaggtgattcaaggtctgccgcttaaccgaaacgcctggcacacaggtgacggcacaaacggtccgggaaaccgcaaatcaattggcgttgagatttgctacagcaaatcgggaggcccgaagtatgaggcagctgaagccttggcgatttcatttgtagcacagcttttgaaggagcgcggctggggcatcgatcgggtgagaaagcaccaggactggaacggaaagtattgcccgcaccgcattttatcagaggggcgctgggatcaagtgaaggcggcaattgaaaaggaattaaacgggggcgtatcagctaaaaaagctgcagtctcttcttcagcgtctgaatatcatgtgaaaaaaggcgacacattgtcagggattgccgcatcacacggagtcagtgtgaaaacgctgcaaagcatcaatcatatcactgacccgaaccacatcaaaatcggacaggtgatcaaactgcctcagacggcatctgcttctaaaagccatgccgcatcctcatatccgctcccatccggcgtgatcaaagtgacaagcccgctgacgcaagggacaaaagtaaagcaggtgcagactgctttagccgctctttatttttatcctgataaaggagcgaaaaatcacggcgttgacggcgtttatggcccgaaaacagctaatgcagtgaaacgttttcagtctgtcagcggtttaacggctgatgggatttacggtccgaaaacgaaagcgaagatggaggaaaagctgtaaatgaaaagacggaagctgtgaagcttccgtcttttcgccttacatacaaactgcggcaagcaccttttgaatatcataaatgctttcatcttttttaaactgctttgagacagcgggaagttccgcgccggagatccaaattttcagctctgaatcaaggtcaaagcggccggcagtttccacgctgaatctggaaatgcttttgtacggaatcgattgaaattccgttttcttgcctgtaattccctgtttatctacaaggataagccgcttgtcagtaaagacaatcaaatcgcgaaccagcttaaacgcggcttcaaccttctcaccctcaagtaaaatatgggcaagctcttctttcacagctgccgttgacagtgttgatgcattgccgagtaatccatcaataaaccccatcatatacctcctctgcgtattctatcaaatcatactataaaaaaggttttcattcatagatgagtagagtaaactggtgctgactggtaaaggggggcgttcaagatggaagatatgtatgacagctttgcggccctttctgcttctgagtcggagtaccggattatttatgaggagaaaaacggaagtgagcttatcgtcctcggtcctcacggcggcagaattgagcctggcgtcagtgaactggtgcgggcattttcggatcgatgttccatctatttgtttgagggtctaaagcagcgaaacaaccgttccttgcatctcactagcattcgttttgatgagccgctggctttagaaaaagtgaatgaccaccattacgcattagcgtttcacgggtattatgatccgaaaatcccgcatacattggtcggcggggcggatcgtaaaaaagccaagctcatttgtgagcgtctgaatgaagcgggtttcagcgccgagctcactaatgagaaagaccgcctggcaggtgtacacccaagcaatattgtcaatcggacgaaaagagaaatgggactgcaattggaggtaagcacggcacagcgaaacgcgctattccgcaattttgggtgccgtgataaaagctacatacaaaacgatttgtttgatcgatatgtggaagccgtcaagcttggcttttataaataaaactagacgggacctgcacggtgggcctattccttcatacgctggggttgtgcgaaagtgtggggaggaatgattcatgttttatcatataaaagagcttcaatatcaagcaaagccagctcatcctgatccggtttatgcgaaaaaacttcaagaggtgctcggcggccaattcggtgaaattagcgtcatgatgcagtatttgtttcaagggtttaactgcagggcggatgctaagtataaagatttgttatatgatgtggggaccgaagagattgggcacgtagaaatgctggcaacgatgatttccagacttctggacaatgcacccgcggatgtacaggaggatgcttataaaagcaatcccgctattgcagcagtcatgtcaggtatgaatcctcagcacgcgattgtgtccggattgggggcgatggcatcagatagtgagggctatccgtggaatgcaaaatacattatctcaagcggaaacctgctggccgattttcgcgctaacttaaatgcggaggcccaaggacgccttcaggtgacacggctttatgccatgaccgatgatccaggggtaagagatatgctgtcatttttgattgcaagggatacctatcatcaaaatatgtggtacgcggccattaaagagctggaggaaagagaacgggatattgtcgtcccgacgacgtttccgcgtgagctcgaaaagcaggaagtctcctatgacctgtttaacttttccaggggagatgaaagctcgcaaggaagatgggcacatggggaagcctttgacggccggggtgaattcaggtatatcccggctccgattgcgttcgcatctgcgcctcatcttaaaccggcgcccatgtggctgcataatacagttcccccaatgtcgaaatgttaggttctcttctgggctgaggaatatatcctcagcccttatttgatcagatgtttttaccaatatgatataacgctttttcctcagcgacctgcaagtgctgctgatcgccttcctcgtacgcatgtggccgcttgtgagataataaataagcgagccgcttctgaaattgaatacctgctttacgccgttcaaacatgtcaagccttttatcagcaaattcctttgttacccggaataccgccgcaattgtggcgagtgcctggcttctccattgcggcagttccatctgcaacagcataaaggttggcacacagaagtggtacataaattgatttgcctggaattcctgaagctctctgaagagcttgttcatctgaaaatgattgcctgcatgctttaacacgtggcacagctcatggccaaaatcctcccattgctcttcccgtgactttttttggttcaatacgatactgtacatgccgtcgtatttcaccatcatgctccccatatcctcaaaatgcacccaaatatccagatcctttgcgattttcagcatgtcaatgtgatgaggggatgtgatgcccagccggccgtataaatttttaacgtattcctccagatgtgataagtaatcgcccaattgaatactccctttcgaacatttgttctgtttttagcgagaaagaaaagcccgtataggactggaaagtagtgtagaaatctttcccttttctttaaaaaataaacacttttttctttatatcggtctactttttatatgttttagagaacagagaacgatttatttatttttcggtttgcggtttttctctttttcttttaaatagttgataaattcgatggcctgctgtttgctttctggggaaaaatcctgcatatcgcggtatgcaagctgcaggtccggatctgagaacacatcgtcatcggattttttgtcttttcccgttaataagtaatcagtcgttacttgaaagtaatcagccagcttttggagtgtgtcgtaatcaggttcgcttcgcccattttcatagtgggaatatcgtgcccgtgacacaccgatgtgtgatgcgatttcttcctgtgtccttttccctctgagactcttcaatctgccgcctatcatactatgacctctcttttttaaactccctaagttacttatgattatagatacaatatgtatcaaaataaagttatgataaaaaaagtatcaaaaataacttgatgatacagaacgtatcgtttatacttggtaacagctgatacaaaatgtatcaaaaaaagatcaggagagtgatcacatgtatccgatccaaatcgtttttagtgaaaatcccatagatcagcgccatctcggacaatccggcggcaccatttcgtttaccgcatgcggccttccggtgtttcactttgaaacgcaggaacagtttcaagcatacatgatgttaaaaggagaagcggcgtccaatgaaaaacgataaaagctatccttttccgacgtattcagggttattgaattcagaacattatgacaaaattggcccggcgctatggctgtttctctggtttatcagctcaacaacaaaagaaatcgaaaaagacggcgtaagctggggcatcgtactcggccataagccgttaaaagcgagagaaatggcggcagtcttcggcgtaagtgaaaaaaccgtcagaagatggctggagcttctcgaaaaccatgattacataaaggccgtccgtgcgccatacggactgatgatttcgctcaagcattccaaaaaattcagcttcagatcggacaatactgtacacgggagtctaaaagaacggccattttcgccgcagacaccggacacaaacgaccgtacagatatagataaaacaaacaaatatactgctgctgatgatgcagtggatcacattgcgaagcggtttacacaattacggtcggctcaagaaggacgcaccgtgtatccttcctcaagagattatcaagccatcgcccgcattgttgccatcggcgttcctgtcacgcaaacaatcaaatggcttgaagaatgctttcaggcttttgaaaaccggcggaccgccgcttctgaaacaatcaaggcttttcgctactgctcgaaattcattgaagatcgatttttcgcgcagcaagccaaaaagactgctgcaattcagcatgagaggatgaaaaaacatgacaaaacgaacaatcgaacagattttggacgagctgagaagagggagacgtccattactggcggacaaaccggccgaatcagacgcaagcaggtatgattgcctgcgctgcaaggatcagggaggttatctcgtcaggcagaatggcctggaagtctggacgatgtgcagctgcatagcagaacggaaagtgaagaggctgctgggtgcaagtgagattacccacgctttcagacagctcggcttcaaggaattccgcacggagggaaagccgcaggccataaaagacgcatttgagtgtacaaaagagtatgttgccgattatgaacaaatcaaggattgccgaaaaaacagcattgctcttttaggacagcctggatcagggaaaacacaccttttgactgccgctgccaacgaattaatgagaacatgctatgtgcctgtcatttattttccgtttgtggagggctttactgatctgaaaaatgattttgccctattagaagcgaagctgaaccggatgaagcaggcggatgtgctgttcatagatgacctgtttaaaccggttaacggcaaaccccgcgctacagattggcaattagagcaaatgtattcggtactcaactatcgctacttaaatcataaaccgattttgctttcgagcgagctgacaattgaagcacttgtacgggtcgatgaagcgctcggcacgagaatctatgagatgtgcagtgactatttagtgattatcaaaggagcagcctacgagcttaaccatagattggagggcgtcagataatgtgcaagctttgtcaaacaaagaaagtcattgtggaacataccggtattggagtcgtttttcatccatgtccgaactgccggtccggcactgacttaacgcctgtcattcaaaagctggagcaaatgctgacagcgggaaaagcgaggctgaatatctatgattaaacagctgactgcactaatcgctttgctgtttcgggcaaagcgaacagaaaaaaacattgaacaatggtataaggacgacgggaagtgaaagtgttggcaaagacaaaacaggcagagaaaagccctgcgccgtggcgtgctgtcccgtgcggggatacgaaaccgatctatatttattcagcttacagtgaagaagaaaaagaaagattcccatattcaaacggacggctgattgccgctgtatttgaccttagctcttattcgcaaaaaagcaatgccgctttgatggccgctgcgcctgaattgctggaagcgtctaaagcagcacttgattttctgaaagggaattctgttcattcaaaggagcgcatcattcagctattagaaaaagctgaagcaagcgctgcaccgaaaaggggaggaaataaaacatgattcatcctaaaaaactgctgcatatcgattccgtcacgcttaagagccagctggaggacgggaaaatccgtgtcattattgtggatggcatcaagcaagaagcatggatcacagaagcgcccgagcatggaaaaacgctcgtcgaaacaagaaagggcgaccttgcccgagtggaatttgaaatcggctacaaattaaattaaagcgaaaacagaatacgtccaagacggaaagcctgcggacactgatcaactgcacagcatttgtgcgttgattggtgtccgttttttatttgccaaaaatgaggaggatcatagaatgcaagacttactatttgaatataaacgaacgctcaaacaaacaagaaaccaatataaaccgctcgctgagacagatgaatccgtgctctcagctgaagagctgaaggataaaaaaatcattagaaatatgattactgatcttgaatatgtaacagaatggcttgaaaaaggaaggcagcccggcatcagacgggcgattgaccggcgtgatgcttaccagcggctgatgatcaaggacccgagaatcatcgaatcattttccagcgctatgatgtttgagccggacggacaggtatcagaagaagacagagatagaattcgagaagcattagccctgttaacggacagagaaaaggaaatgtttttgctgcataaggtagaatgtttttcttatgaacggatcgccgatcttctcggcgtgaaaaaatcgacagtgcaaacgacgatcaaacgggcaatcgtaaagatgcaaagacagcaggaagacatgaatcgatcacttgcatgaaagcttgtcatacgtttgccacctataagtgaatagcatgacacataagcggctggctgatcagccgcttttatgaatagacaaccatgctggaggtggcggtgatgccgtagcatgaaaacacaacttcgcgaacaagcattagcaatctatcaacaacatcaaggaaagatcacaaatcgggcgattgcggacacaatcggtgtttccgcgaaaacaatcggcatctggaaaaaacaagacaaatggaaagaggcgctgttttctgcgtccaaaaacgaacaaaaacagcgccctatagacaacgatgaattaaatgaacgccagcggctgttttgcctgtattacgtcaaaagcttcaatgccacacagtcagcaatcaaagcgggctattctcctgacagcgctcatgtgacgggcagccggctcttaaaaaacgaaaaggttgctgctgaaatcagacgcattaaaaaagaaatggtcaatgaaatgtttattgaagcgatggacgtgctgcaggtttatatcaagatcgcgtttgcggatattacggactatgtgaccttcggaaaaaaagaggttcaggctgtcgggaaatcaggtccgctgtttgatgaagatgataacccgattatgaaggaaatcagctttgtcgatgtcaaagactccgggctcgttgatggcaccattgtaacggaagcaaagcttggcaaagaaggcattgccatcaagcttgcagataaaatgaaggcgcttgagaagctatccttatattttgatttgtttccagatcaatttaaacaaaaaatagaaaatgagaaattgaagcttgccaaacaaaaagcggagaaaacagatgacagccaagagccgattgaaattatgatcaaacgaaaagagcgcaagtcatgattgtaaaagaaatcaacccacatttcgaagattacgtgttcaattgggagcagacgtaccagtttcttgtcggcggctacggctcatccaaaagctatcataccgcattgaaaatcgtgctaaagctgctgaaggaaaaacggacggcccttgtgatccgggaggtgttcgatacccatcgggattcgaccttcgccttgtttcaagaggtgatcgaagagctcggtctcacaaaggccgtggcatctctttcttccccgctgcagctgcgatttcacaatggcagccggatcatgttcaaaggaatggacaatccggcaaaattaaaatcggttcataacatttcattaatatggattgaagagtgctcagaggtgaagtatgaggggttcaaggagttaatcggacgtcttcgccatcctgagctaaagcttcatatgatctgtaccaccaatcccgtcggcacctccaattggacgtataggcatttttttcgggatgaacgcaagaaacggtttgtgctggatgacagcgaactttacgaaaagcggacgattgtaaagggagatacgtattaccatcattccaccgctaacgacaatctttttctcccggaaagctatctgaaacagcttgacggactcaaagagtatgatcccgacctgtaccggattgcccgcaaaggacgattcggcgtcaacgggatcagggtgctgccgcagttcgaggtactcccgcatgatcaagtgaaaaaatgtatcgcagccatcagcaagccaatctttcgtacaggcatggattttggattcgaggaatcctataatgccgtcgtccggcttgctgtagatcctgaaaaaaaatacctctacatttattgggagtattatcaaaataaaatgacagatgataggacggctgaggagctgcgtgagtttattgagacacaggaattgatcaaagccgactcggctgagccgaaaagcatccaatatttccgccagcagggctttcggatggttggagccagaaagtttcccggctccaggcttcaatataccaaaaaggtaaaacggttcaaaaaaatcttctgttcggaccgctgtgaaaatgtcatctatgagctcaagacacttacgtatgccaaagataaaaacggagctctgattgaggatgaattcacaattgacccgcatacgctttctgccatttggtatgcgcttgatgattatgaggttgctgatatgaaagagacagcacacaaacgaatccggccgaaccgagaaaggaggaggtcataaatcatgcacaatcaaacagtcagagcaactgtatttaaagccaatgccgccgctcctcagacaaagcaaatctatgaagatgacttttctgagctgtacggagaggacattatcgctccgccctacaatatcatcgagctcaaaaccattgccgaatactcgaccattcttcagcaatgcattgatgcgtacagagtgaatattacaggctttggattcgatgttgagtacacatttgatgtcaacgcaagtgatgtcgatcaggcaaaaaagaaaagagcggaaaaagactgggccagactcgaagccttttataaatgtcttcactttgatgaatcagctgaaatgattttaggctatgccatcgaagacagagaaaaaacaggcaacggatttatggaagtgcttcgcgacggggcgggaaaacctgccggcatcgaatatttagatgtgaaatatatgcgtgtatgcggagctggcgagcctgttgaggtctcatttatatatgaagaaaacgggaaaatgaaaaggatcaaaaggcaaaaacgcttccgaaaatatgtgcagatgattaatggaaagaaagtattttttaaagaatacggcgatccgcgaaaaatggatatgcgtacaggtgaatatgtaaacacattggcagagaagtatcaagcaaatgaagccattcacctcaaaatcggaagcggcgtatacggtgtaccccgctggatcggcaatattgtcaatttatacggagcccgaaaagcagaagagctcaattttatgtattttaagcaggggcgtcacgtccccgctgcgattacagtggaaaacgggatgctgtctgaagcttcttaccgggagctgcaggaatacatgaatgatcttgaaggcgtggaaaacgcccataaatttctcctgatcgaagcggaaggaatcgcaaaagaaaaggatctccacggaggcgaggatattacgccggtttccgtggaaatcaaatccttggcggaaattctccaaaacgacgccttgtttcttgaatacgatgaaaaaagcagaaataagctgcgttccgcgttccgcctcccgccgctgtatacaggcgaggcccaggaatacaaccgggcgacagcggataccgctagaaaaattacggaggagcaggtctttcagccggagcgaaaaacgctcgtgaataaactgaacacgctgcttttgccggagctgaatatccatgacgtcaggctgacattaaaaggaccggactttcgtgatccgcttgagattgcgaaggtgctcggtccctttattacagccggagcagtctcgccgaatgatttacgcgaccttgccggacgggtgcttggcaaaacacttgaggagtggccggaggacatttataaacggcctgcaggacaggatgcggaaaagacaaacctgactgcgctcatgcaggagctgaaagaaagcatcgaagatatcaaaacgtcctgaagggaggtgaatcaagcaggtggcgcgagaattaagaaatgccaaaatcagctttgtcagttatgtggacaaggcggctaaccagacagaatttttctttacgaagtcagccgaacctccgtcatttgaaaaaaaggttcggctgtttacaaaaagtgagcaggatgaacaaaagctcgtgtacggaatcgtgtatgagcctgatgttcctgatgcccacggcgattttatgaccgccgaggaaattgaaaaagcagcgcacggttttctcgcggaggcacgggaaattgatatcaatcacagctttgagggcggaaccggcgtcgtggtcgagtcctatgtggcgcccgatgattttatgatcgggtcaaagcggattacaaagggctcatgggtgctcgtgacaagagcgtctgacgaggtgtgggaacagattaaggctggaatcatcaccggctacagcatggcgggcactgcagatgtgtatgaagaagaaccggtcgaaaaagcagggttcttcagtgtattcaagcaaatgcttgctgacaaaacagggaaggagactgaagaaatgagaaaagaagacatgagagaatcattcgagcatgcgctttaccctctgctcaaacggcttgagcggattgaaaaaaacacagacacggaggaaaagccggagcagacgggtgatgacgagcgtctgaaaaagctcgttgaagacatgcttgccccgctgatcgaacgcatcgaggctttggaaaaagcgcgaggcgcgtctaagcagacagcggacgatacgggcggcaatacagagcaagtcaaaaaatcaatctggagcggactgctgtaaaaccagtcaaggaggaggaaatcaattgagaaatcaagagatcattcggaaagcggaaatgtcgctttctgctttaaaaagcggcgggcttatgaacccttcgcaagcatcggcttttatccgcatggtgcaaaacacgccgaccattttcagtgaatcccgcgtgattcaaatggaaaacgattcgcaaaaatttgaaaaaatcggcttcggccagcgtattctgcgggctgcgcaagaaggaaaagcactgtcaaacgacgagctgacagttccaacgacaagcacggtccaattgaacacgaaggaagtcattgcggaaattaacattacgtatgacacactcgaaaacaatattgaaaaagacggcctgcagcagacgatcatgcagattttagcagagcgcgcagcagttgatattgaagagctgattgtaaacggcgatacagcatcagctgatccgtatctggcgcagctggacggtatccgcaaacaagcggtgtcccacatcgttgacatgaatggtgaagaactgtccagagcgacattcaagaaaggcttaaaggctgttccgccaaaatatttgcgcatccctcaggaattcagattctatacgtcgcacggcttagaagttgaatggaaggaccgcgtggcggaccgccagacaaaccttggggaccaggctgttcagggcggtttgtccacagcattcggcgtgccggtcaaaggggtatccaatattcagccgtacacagtcggtgagggagacgcgcaatatgacgcttctgatatcattctcacacatccgaaaaatatcattctcggcttctcccgcaatatccgaattgaagtcgacaaagacatccgctcccgtaaattcattattgtcttaacggccaagctggacagcaagttcgaggaagaggatgcctgcgcgaaattaattaacgtaaaagaataatagaaacgaggtggtcagctcatgctcattgaaccgactgacgtagcctcctattcggtctatgatcgggtgaaaaacaggccggaagagctgctggcgcaggatatcatcgaggcggaggcagaagcggttctcatcacgggccaccgctttgaagacagcttgtatgatccgctgcccggcaaggtgaagttggctttgcttaagcttgcccagtattttgcgcttgtcaacagcgatgaatctgcctcatcaagctatcagtctgagaaaatgggggattattcctacacggtttccggagaaggcgggattcagcggcctgaggtgtatcatttgctcgaagagtttatcaagccgggctacgtccctgaatcctccagactgaaggtgagatctttatgagctacaagcagatgctcattcaccgttgcgacatttatcatgaagcagcgcaagcgccgtctgcaggccgatttgggattccggcagacaggctgcagccggtgatttcatatccggagacacccgatgaacaagatgtcccttgttattttaccgaaaaaacgcagcagctgattcaggaggagccggatcaaactgtatatcatagctttctcgtccattttccgttgtcagcggacatccgcgtgaacgataaaatcatttgggagaatcataaatatatactaaagctgccgaaaaggatcagacatcatcattgggaggtcatcgcagtcagggatgaaagcttatgaaaatagcgggattgaaacagctgaacacggcattaaaagaagcggcttcaggcggtttttccagacaggcgtcccggtggcttgaggagtgcgggcaagattttctggagatcgtccaatctgaactcatcagcgcacaaacgattgatacagaaaaactgctcagttcctttgagaaaggcgcagaggacaatctctggattgtgcaaagcggcgggctttcgcttgaggtggggacacagcttgattacgcctcatttcttaatgacggccattggacgtcaaaacaagatgtgagatgggtgccggggcgttttcaaggctcacggtttatttatgatccagcggcttcaacgggaatggcgctcaagagaaaatggataccgggcacgagctactgggatcatgcactgcttttatatgaacagctgtttgaaaaatcgctggaaagcaaactgcgccagtggctgaagaagctgtaaaggaggagcaggatgaacagtgaaacaggatcgatcatggcgtttttgtacagccggtggtctgttcccatttatgaacgcgagcttcctgatcactttcaggtgccgtcgttatacgtcccgccaccatctgttttcgaggaaacagatacggtctccacatttaaaaaaacctacagtctcaatgtaaaactgtttcatctggactccgttcaggcgctggatgaagcggacaggctcgcggatgccataagagaagcgagaaatatgattccgctgctgagtgaatccggcgagaagacgggggatatggttcgcatctcccaaatcgagacaagagtaggagacaggggcgaggcggccatggtgatcaggtggagcagccgatattattatcacaaaatagaacagcctgtcttacaggatatcgacatgaacagcggggtgaaataaacggtgtcaaaggacaaacaacagaagaaggctgtacatacaaagagccgggaagctctatttgatacagcggatttgattaagcacgcgaaggaactgttcggcgttaagccggatattcttcaggggctttatttggcgtggatcaaccacgtatgacgaaatcagaagccaaccaattgattcaaacatttctaaccaaggaggtcatgtcatcatgaatggcggaacatttacaacaggcaaagaaaaagaacgtgcaggcatttattttaactttaaaacgacggcacaggagcgggtatcactcagtgaacggggaacagtcgcacttccggtcgcatcaagctggggcgaagcgaaaacgttcgtctccatttccagcgttgaagacctgaacaaaaaagtgggtctcagcattgatgacccgtctttattgctgctgcgtgaagcgaagaaaaatgcgaaaacggtattgatgtaccgtctaaccgaaggtgtccgagcgtctgctgatattgctgaaggcgtcaaagcaactgcagtatatggcggaacaaaaggaaatgacattatcatccgcatcaatcaaaatgtgctggatgctaattctttcgatgtgacaacatatatggacgaatcagaggttgataaacagactgtcaaaaaggctgaagaattaacagctaacggctatgtcacttttaccggaacaggcgatctttcttcaacgattcctctcactggatcagaaggagacactgcagctgagacgctgaatgcatccgcgggaatccgtttatctggcggtacggataaagcccctgtcaactctgactatacagatttcttagccgcggctgaaacggagagctttgatgtgattgcattgcctgttgcagaaggtgaccagttgaaggcgacgtttgctgctttcattaaacgccttcgcgacggccaaggacaaaaagtgcaaggcgtcacagccaattatgctggtgattatgaaggcataatcaacgtaacagagggtgtgctgcttgaagatggcacggaagttacaccggacaaagcaacagcttgggtagctggagcgagtgcaggagcaacctttaaccaatcactcacatttgtagagtacgaaggcgccgttgatgtgttacaccgcctcgaccacgatacgattgttgaacgtctgggcaaaggtgaatttttattcacattcgacgcccgcgataaatccgtcagtgtagaaaaggacattaactcactcgtgacgttcacagctgagaaaaacaagaaatttgcgaaaaacaaaatcgttcgtgtcctggatgctgtgaataatgatttaacacgcgagctgaaagccttaattaaatcaagaaaaggcagcggaagcgatatcccggcatctgaagacggactgcagtatgtaaaaacgatgatcacgcaatacatgacaacacttcaggatgcaggcggcatcactggctttgattccgatgaagatatcacaatttcaatgaatgaagatcgtgacggcttcttgattgacctggctgtacagcctgtcgatgcagcagaaaaattctactttaatgtggaggtaaactaatatggcattaaaagcacaaaacacaatctcaggaaaagaaggccgcttatttctcgatggtgaggaaatggcgcacatcaaaacatttgaagcaaacgttgagaaaaacaaatccgaagtcaacattatgggccgccgcatgacaggccataaaacaacaggggcaaacggaactggaacagcaacgttttataaagtcacatcaaaattcgtgatcctgatgatggactatgtcaaaaaaggcagcgacccatacttcacactccaagccgtgctggatgatcaatcctcaggccggggcacagagcgagtcacgctgtacgacgtcaactttgactctgccaaaatcgcaagccttgatgtcgattcagaagcgttagaggaagaagttccatttacattcgaagacttcgacgtccctgaaaagctgtctgacacgttttaataaaaggcgcatacgcagacctttctcagaaaggtctgtttttttacaggatcaaactaaacaatagacaagggagttttttacatgagcgagaagaacgaaaacgtatatgatctttccttttttatgccgggaaaaacaattgaagctgaggaaatcaaagtgccaatctcaaagcgttttgttgataaaaaagggaacatcgtgccatttatttttaaagcgatcacgacggagcgcattgatgaattggagaaagaaacaacaacgtataaaaatgtcaaaggcagaggccgtgtaaaagatttagacagccaacgcttttatgcccgaatcgcagttgaatcaaccgtttatccggacttccgttcaaaagagcttcgagaagcttacaaaacggctgacccggtagaagttgcgaaacgcgtgctctcagttggaggcgagtatgcgaactggttaaacaaagcgattgagattaatggatttgaagatgaattagaggatctggaagaagaagcaaaaaactaatcaaggatgggcataaagaagccgtgtatctctactatgcgatgcacgagcttcactattccccatcagatttattggcgctctacgaagcgcccagaaactataaagcgctgttgtatggaatgatcggatataagctcgatctccttgaaaaacaagcaaagaaaggaggggcatcgtaattggcaaagctgacagcaaggtttgaaatggaagaccgtgtaagtaaaaagttaagaaagatccagaatgagtttagagcacttgaaaagtatagaaaaatggtgcagcgaaaaagcgctattgatgttcgaaaagaaagcaaaactgtattaaggacaattgatcgcatacaaaaatcattaaagaaaaagcttggcgcccaaatgatctccatttcaactgaggataaagccagcagtgtcattcagcaggttaatgttcaattgcagagattgccgtcatctgtatctataaaaatagatgctagtgaccaagcaaccgaaaagtttgaacgattaagagagctcgtggcaggttttaaaggctttacgattatgctgagtgcagaagatcaagtgttgccggctgtgcaaaaaatacagcgctatatggaaactgcacttaaaaatggttactctgttacgatacgcgtgattgatcacgtcatgaaaacagtcggtcgtatttctgctggtattgatgccttaacaggaaaagacaacaaacttgagctcgctattaatgacagggtgtcaaataagctggattcattgcagaaaagaattgacagcatgggaagctcaggtccctccgagaaaggagcgccttcatcaggaggaaatacaggagatattgcgagcatgtttgatccagaaacgattttgacagcactggacaaatttgctgcttctttcatggaaaaggtggatgaaatcgccacaaagttcagcccggaaacaatcttaacagagctggataaatttacgacatcgttcatgaataaggtggatgaagtcgccacaaagtttagtccagagacaattttgtcgcagctggataagttcacaacatcgttcatgagtaaagtggacgcaattgcaacgaagttcagtccagaaacgattctggcacagttggataagtttacaacatcgttcatgagtaaagtggacggaattgcgacgaaattcagtccagaaacgattttgtcacagctggataaatttacaacatcgttcatgaataaagtggacgcaattgcaacgaagttcagtccagaaacgattctggcacagttggataagtttacaacatcgttcatgagtaaagtggacggaattgcgacgaaattcagtccagaaacgattttgtcacagctggataaattcacaacatcgttcatgagtaaagtggatgcaatcgcaagtaaattcagtccagaaacgattttgtcgcagctggataaattcacaacatcgttcatgagtaaagtggacgcaattgcgacgaaattcagtccagaaacgattttgtcccagctggataaattcacaacatcgttcatgagtaaagtggatgcaatcgcaagtaaattcagtccagaaacgatttttaagcagcttgacaagtttacagattcctttatgaaaaaagtggatgcaaccgcaagtaaattcagtccagaagcgatttttaagcagcttgacaagtttacagattcctttatgaaaaaagtggatgaaatcgcaagcaaattcagtccagaagcgatttttaagcagcttgataagtttacagattccttcatgaaaaaagtggatgatatcgtaagtaaattcagcccggaaacaatctttaacgagcttgacaagtttacagattccttcatgaaaaaagtggacgatgtcgtaagtaaattcagcccggaaacgattttaaacgagcttgacaagtttacagattcctttatgaaaaaagcagatgatgtcgccagcaaattcagtccagacgccattattactaaagcggaagactttgtaacaaatattgttgacaaaattttagagaaatttaatttcctgaacccggataaaatcgctaataaagcagaaaagtttgttgataacattgtttcaaaaatcgccaagaaattcgagaaattcagccctgataaaattattgaaaaagtgggagagttttttgaaaaaattataaaaggcattgctgagaagctggggaatctggatattggcgggttgtttggcggcaaatccagcggaagcaaaggcaaacaaaaagcttcaaaagccaatacaaagaactcaacttctaacaattcaaaccgcactaaaaaaccttctatgaaccaaaaatcttcaggttcaaaatcgaaaaagtcaggcggcaaatggggcggggcttgtggttgctgctgtgccggaatcagtacaggcaaaagcaaaaaagtcaaaaatagaaacggttcatcaacaaaagggaataaaacaaatcctgtgaatacacctaaatctgctaaaggagcagcaggcaaaggtttttcaggccttctgaaaacattgggtgaatcaaaaggcttaaaaggcggactaaagggcttaaaaggagctgcaaaaggaataccgggattaggcgaaatactgtcccttactgacttagccggtatcaataagaataatgctggtgaaaaagtaggttcagccggcggaggtttagcaggagccgctgcaggagcggctattggaagcgttgtgccgggagtcgggactgctattggcggtgttgtaggaggaattgccggtactttcggcggtgaaagtttaggtaaggcaattgatgccggcgctctagaagatacatggaacagcattacagagggtgcgcaaaatgcctggtcagccattcaggatacttggggaactgtatcaacatggtttatggataatgtctggacgccagtgtcaaccgcagttgtgggtgtagcaacaagcatatggtccaacatcgtgaatgcttggacaacgatccaaacgatattcagtactgtatcaacatggtttatggacaatgtctggacgccggtttcatcagcagttgtgggtgtagcaacagcaatatggtctaaaatcgtaaatgcatggacgacaattaaaaatgtgttcagtacagttgcttcatggtttatgagtaatgtgtgggggccagtcaaatcagctgtaataggagcggcaactacaatctgggataaaatgaccggtgcttggaataagattaagagtgttttcagtacggtatcgggatggttcatggatacagtttggaacccggtcaaaaatacagtctcagatgtaggtaagggaatctcagatgctttcaaaaaagcgatagacaccgttaagaacatttggaaaggcctgagcggctggtttaaaaagaatattcaagaacctcttacaaaggtgggagaagcgatttcagatgctttttctaaagcgttcggctgggtgaagcaaatctgggataaagctggcggcgtagctagtaaagtaattaattttgtaaccggcggcggtgatccgaataaaggtaaggatccggataaaaatgccacaggcggctacatcaccaaaccaaccatctcgtggatcggtgaagccggcaaggaattcgttatcccggttgataacaaccgaggccgggggaagatgcttctttcacaagcggcgtctaagctgggtatgcaagttgtagacgacatgggagcagcttcgtcttctggcggaagtccagcatctgtttcaggaggagcagctgtcagtcctctatcaggctcagcctccccagcaatgaacactgcaaatcttacaggccaagcgtccacactcggacagcaattttcagaaggctttggtaaaggcatcagcgatcagccggtcaaaatggaagactggaaaaagaaaaacatcaatacgccatttacacaaatgatttctgcttcaccaaattacggtaaacaaatggtaagcgggtatgccaagggtcaaaacggcactgcaaccggaacggacggctttttgcaatcaaaagttaaaacgccgtaccaagccactgtgaacaaatcgtcttcatggggcacaggaacggtcaaaggctttgcgcaaggacaaaactcaacccaaacagggactgcacagtatgtgagtacacatgttgacaaaccgttcctgcgttcaaaagacacatcgaacagctggggttcaggcatgatcggaaactttgtgacaggcatgaattctaaatccagtgaagtaaaacaagcggcaaaggatatggccaagagagtggagcaggctttccgtgaggaattagatatccattcaccttcccgtgtcatgatgagcttggggcgttttgcttcaattggtgttgtcaaaggccttggctcagtagatgtaaagaaatatgctgaaaaacaagccggatcactggcggctgcctattccggaatgggagccatgggcgggaacgtaaaacagtggattatggccgctctcatggccaccaagacaccaatgagctggcttccgggtctcttgacgattgcgcagcatgaatccggaggcaatccgaacgcaatcaacctgtgggacagcaacgcaaaagcggggcatccgtcacaagggctgatgcagacgatcccaagcacttttaatgaccataaagcaccgggtatgggtaacattaaaaacccgattcacaacgcagctgctgcgatcggctacattaaaagcagatatggatcaatcaacaatgtgccgggtattaaaagcctgaatcatggcggaccgtatgtcggttacgcaaacggcgggctgattacaaaagaacaaattgcccgtgtcggagaaggaaacaagcgggaatggatcattccggaggagcgaggcatccgcggccgctacctccttcagagagctgcgcaagctcttggtatggaagtgacagatccgtctcaatcccagcagtctgagctttcttcaggacaagtttcagcagttacatccggtacacggcaaacgatacaaacagccggaacgaaagaaataaagattgagtttaacggcgatcagcatttccataatggacaggatgctgatggcctggttgcgaaaatcaagcaggcattacttgatgaattacaaaatgacattaacaccggaacaaagggggtcgtggcttttgactaagtctatctatgaattttggatatcacaggggaaagaaaagctgcgattccctgttcttcctgaagcgattgatatagcgaatagtgtacaaaatgactcagtaaagataacgggattgggtgaactaacgtttattgaagaacccggagcaaaagaaatttcattttcttctttttttccaaaaaagtatacgccgatagctgaatatcaaaatctcccgtctccggaaaatgccattgcgaaaattgaaaaatggatgaaggcaaaaaagcctgttcaatttttaattacgggaacaaaaatcaatatgacatgcagtattgaaagccttaaatatagtgagggagacaatgaaataggagatcgggattttgatattgtattaaaagaatacaaaaccgcttccccgcggaaaatcaagcagaagaaaaaaacaaaggcaaaacgtccgtcgaaggctgcgccgaagacgtacacagtgaaaaagggagacacgctatgggacattgcaggcagattttacgggaacagtactcaatggcgcaaaatttggaacgccaataaaacagcaatgatcaaacgaagcaaacggaacatcaggcagccgggccactggatttttcccggccaaaaattaaagataccgcaatgaaacaggtgatgtatgatgatagaactgttcgtcattaaagacacagagtggcttgagctggttgcagaaagcgtatcgcttgaaggccatcgttatcaggcgccgcgctccattgaagcgaccatcgtcaccaaacagggcgaccagacgtattacagtgtctcagaaggagatacggtcttgtttaaatggaagggaaaagagctttttcggggcattgtttttgcaagaaccccggacgagcatacgcttgccttcagcgcttatgacatgcttcaatacctggtcaaaaaccaggatatgtacgtgttttccaatcagcgggccgaccagatcatcagaaggattgctagtgacttccagataccgacaacctcgatcgcaaacacaggccatacgatcaaaagtcttgtcattaaaaatgatacgacattgtatgacatcatattaaaagcgctgaaacagacgaaaagccagacaggacgacattaccagctgtattcggaaaaaggaaagctcggtctgcgcgcttggccagatccgtcagaggtatgggtgcttgaaacgggcgtcaatatcacgggctaccaatacagcacttctataaacgacactgctactcgggtggtgcttcgccggcagaaggacaataagacatataaagcctctgccaaggacagttcaggcttaaataaatacggtgtgcttcaatatacggaaacggtcacagatgacatcaaccaggcacagcttcagcagcgggcagatgtacggcttgctgaaaaaaagggcgtgaaaaaagaactgaaaaatattcaggcagtgggcatcccggaagtgcagagcggcttgcctgtctatatttctattccggaggccggcatcaagaaaacctattgggtagatacggaccggcacgaatttaaaggaacgaaacatacgatgacgatcgatgttgtcgaaaagaatacgatgccggaaggagtttcctgatgagattaagtgaggctataaaacatttggcagtcggcgcagttgacgctgagtctccggtagaactgctcccggctgaagtcgtttcggtttctcctgtggaaatcaaattaaaagaaaacagcaaactgatcataccggaagacgccatcattatcccaaaacgaatgcagtccggaggagacgatgcactcgagccgggggatcgcctcatgaccgcggctctgactggcgggcaatcgttttttattttagataaggtatagacaaaaccgcttcagtacgaaggggtttttatttagcatgtaaaaggagtgggcatcatggccctgacaccagaagtggagtttgaagatattgaagttgagagcgaagtcattgaaacctcgcaaacgtacaaaatagattttgaaaacggaagaattacgaatgagctgattaccgggcttgaagcgatcaggcagttcgtgtatatcgccttacagacagaacgctatgcatattccatatacagccataatgtcggaaacgagcttcaggacgtgctgacagatcatgagacgactgatgcgtataaaaagatggagattccgagactgatagaagaggcgctggtttatgatgaccggatatcggctgtaacagattttgagattgaaaaacaaggcgacgcgtttcatgtgtccttcgtggtggagacggatgaaggaacgcttgagattgaggaggtgattggcgaagatgtttgaagatcagacttttgaagcgattatggagcgtatgctgaacagcatttccgcagatattgacacaagagaaggcagcgtcatttataatgcgttagccccggcggcggccgagcttgcgaagtcttatatatggctggatactgtacttgagctcgttttttctgataccgcacaaggcgaatttttagacaggcgtgcagcggaagcgggaattgaacggacagccgcgacaaaggcggtcagagcgggagagtttacatctggagttactattcctgtcggctcccgcttttacgtggataatctttattttcaatatacggcagacgggacgctcatctgtgaaacacctggtgaagcgggaaacgccaatctgaccggacgcaatttactgtcattggataccattcccggtttagaaacggccattgtcaaagaaatcctgattccggggcgcgaggaagagggagatgacagcttgcgagaacggtattttacaagggttcggcgtgaggccgtcagtgccaataaaatgcattataaagagtgggctgaggaagtggacggtgtgggaaaggcaaagatcttcccgctttggaacggtgaaggcacggtcaaaattgtcgtcaccaatgcgaatcttgagcccgcttctcctattttaattcaaaaagtgaaagattatatcgaccctgaaccaggacagggagagggacaggcgccaatcggagccgttgtcacggtggaaagcgcggtctggaaggaagttgagatttctgccgaagtgctgccggagatcaatcactcaattgatgaagtgaagtcggaaattgaggaaggcgttttaaacctctttaaaaaaatggcgtttgaagacaacgttatccgcctttctcaaattaacaatatcgtctataattcaccatcagtcagtgactactccaatattcaaatcaacggcacgtctgaaaatctggtgctgagcaacgtggaaattcctaagcttgggcaggtgaagatcattgagcaaacaagatgacatgcgagcttatctgccgccgtttctcaccagccttaaagaaatggccgagctgctgaaagcggaagcgcctgagtttgataaacaaaatgacagcatatttgatctgacggatcagttattcgtaccgacggcgacttgggggctcagccgctgggaaaaaattttaaacgtcccgcgggaatcaggcgacactgatgagatcagacgattgcggctcatttccaaaatgtcgaacatcccgccaatcacatacagggccattgagcaggcggtaaaccgtttcttgaaaaacccgtctgcacaggtccgcctgcttcccggcgaataccgatttaacgtcgatatcaatgttgatgacctccagcacatgaatgagctgatcgaagcgatagaaaacatgaaacccgctcatttggcgtatacgctcagaggcggattgaatgagacgctgcaaatcaaagatacagtcatcctgaatcaccgcagataccgaacggccagtgagctcaaggtcggttattctgtcactcttaacaacaatgaggtggttttaacttgatttcaaccatatacagagaacgcacagcggctgatctaaaaagcagaatcgatcacgtgctgctcaacggccaaaaaacagaaatagtagagctcgccattgacggtgcgaccgtcaccgttctgacaaaacgtgaggaagacattaagcatatcgaaacggtacaaatttttgacgagctgggcaacatcatcacagagagaaagactgacctggacgtcagcgaaaacagaacacttgatttcagatttacttttgaggtggtgtaaacatgacatacgaagaaaaaacagactggcttccggacgaccccatcaacgaagatgacgtcaaccgctgggaaaaaggcataaaagacgcccacacagacatggctgcccacaaaaacgacatgaacaacccccacaacacaacaaaggcgcaaatcgggctggggaatgtggataatgtgcagcaggcggcgaagaaggattttgacaagcatgagcaagatcaggtgcggcatgttacagaggaagagcgagagaaatggaatgggggtcagttatcgaagattacaaaagatgatggctcagtctttatcaacatagacaatggacaagattttaacaaagcagctgctgagcaaaggaagtcatttacttttcacacagaaaatacaggagtgaatacacctccacaatcaacgaaaggcatttatttatacttttccgaaaacgacggggaagcgattgctatgacaaatgacgggggaatttggagaaaaacattaacgagcggagtgtggtccgaatgggtatcattcgagacagaagcaggatctaagagtaagtctgaacaggctgaggaaaatgctaaaaattatatagacaaacatattggtaatagcaacattcatatcactaatgatgaacgtgtgaaatggaatggtgctcaactcaaaaaattgaccaaagataatggtagaagaactagggtacctgatgggacagatattctatcattatcaaccggtttttattatgcattaggtaaaaatatagtaaacaacccagttgaaggagataatgcttggtataactatgatgtcatagagggggagagcagcagaaaaacaattgttgcttaccaaagctatgaagtgaccatgtggatcggaatggttcatactgacggtgagttcagaggatggaagcggctgattacttcagaagaattaaaaagtgaaaatatcaataaaattgctgatgagtcactgtatcaagatgcagcatattcaggtaacaattatccaatcggtattaccaccgtcagtattctccaagggtctacaggttatccctatgaatttggtgaagtgctgaatataaaatcgagcatatatcgatttgcacagtttttcttttatgccggaaacgcaggtcaaaagaaaatatttattcgtcactggtatgatagcacaggctggactgagtttattacgatcccttcatcagatgaactagaaactgttttaaatacagcaaagctttatacggacagtcatgctaataacacggaaatccatgtcacgcagaacgataaaactaagtggaataacagtcagattttcaaattgactcaagatgatggaacgttgggaaaattctacaatgaagatttaaataatataattaaaacaggattttattatatttattcttctacgactgaattaaatgctcctattaatagaaatgggtatttgcttgtatataatgttggtacctatccgtatcaagaatttactacttattcgggagaaacagcttctattccagacaatagaagaaaatttatccgaaataaaaagcaagattcagaagaatggactccgtggatggagattgaaaattcacaaggagcacaggcaaaagcagacaaagctttagctgatgctaaaacctatgtagatacaaattatacaaatcaaaaattaaccaaactttcaggctctgatgcaataacagatgctagaactggaggggatgagtatcctcagggattaactttaatagatattggtcaaggaaataataccggttacccgcttcgttacggcttcgtgaaaaatgagaaacacagtgattttagatttgttcaatatttttatggcactggaaatgaatctggcagttacattgatagtactggtacatggataaggcattggtggagtgggtcaggctggacagcttggcataaaatttctggatttgctcatgcaaatataggaactacaggcatacagtatttggataaaaaagcccacacaaaaattcaatttaaccgcaaaagaaaagatagtcacaatgcatttgatacaaaaaatagtagattcgttgctcctaatgatggaatgtttttagtaggagtggggctgtatatgataaatacaccggcttacatcaattttcatctgaaactctatctaaatggatcattgtataaaccaattgaccataagagaggggactttgttgataagcaaaatgaaatgtaccttggattaaatggtaatgtaaccgttcctatgaacaaaggtgactatatagagatctattgttattgcaattatagcggtgatgatagaagaggtgtatccgattttaacgaactatacaactatatagacgtccaagaacttggaggacttaactatcctacagtataagataggaggcaaaatgatgatcgcagaagcaatcatgtttaaataccccagtgcagacccaacaagagattttatcgttcagaatgacggggaagggtcttatatagctgaatggaatctgcgctcgcccatcccaacacaaaaagaactcgaaacctggtgggaagagctgcaaaaaaatccgccgtacgagccgcctgatcaggtggagcttctcgctcaagaattgtcacaagaaaagctggcacgcaagcagcttgaagagctgaacaaaactttgggaagcgagttgtcagatataaagctatcattactttccttgaaaggagatcttgccgaatgaattattgggtgctagccctttattatgagtgggcgacagcagatatggtaaaacaagcattagcatataaagactgttcaattgaggagctggcagagggtgtgaacaaaaagctgatcacagctgaccagtataaagaaattaccggtaaagccatgtaaggcttttttattttgcctgtttttagatcaaaggaggatgaagatggtgaagtatcaatatgaatttcctctcgataaggctggaaaagccggcgctgtaaagccctatcgaggaggaaaaaatgattttgtgacacctgtttcgaatttgtcaggcgtagcggagattttaacaaatgctgctttaaaggcgactgaggcatacagtcagctcgggcaggacaggcttggcgcagttctgatttcgaaagtgaagggctgggcgtatgcagatcgtgaaggtacgctctttatagaagaaagcgacaacaacaatgtttggacaacgacagcagcagttaatgtcgcagcaggcgtcctgacagcgacggactgggtatatctttctaaacgctattaccgtttccgctatgtgaacgggaatcttcagcaatctgagtttgtattataccaatcagtcggtgcgggtgagatggatgtgcgtgtcaatgaaaaaacgcctttacagattgactttgcggagaatcaaacacacgatggacggctgaaagtcgaggctcgcaaaacatttgactttgtctttcatgaaaatgcagagtccgccggcgagggggctgctttacctgttgacggtgccgcgcatttactcgttgaagtctacggcacagcagaaatgagcgaagtcaaattttggggcaaatcggtgtcaggacagaaactgccgatcagaggcgtgaaaactgatgatgctaccactgcctccagtacattaggaaaagctgaggcatgggcctttgatattaaagggtttaaggagatcatcatggagattatcagtatcaccggcggtactctttcggtaaaagggaccgcggtttcataatagtctcggccctcggaagggaggtgatctgcatgtgaaggaggagtgagagatgcagcaagaggcagacgtgaatgtgtttcagcaggatttagcagacatgaaaggcgagcacaaagcacttgagcagagggtttccgcattagaacgcgtgtctgaccggcaagaccagcaaatcatgacgctgaacgaaaaattaaacaaaattgaagaaaacaccacgtggattaaacgcaccatcacaggtgccatcattacagcagtgtctacaggcatcattggcggagccatcgccattatgtacagcctgctgcagcattaaagggggatttttatgaacacgtttgacaagggcacggtcatcaggacggtgcttcttttaattgctttaatcaaccagaccatgctgatgctcggcaaatcaccattggacattcaggaggagcaggtcaatcagctcgctgacgctctttattcagccggttccatcgcatttacaattggaacgacacttgccgcttggtttaaaaacaactatgtaacagaaaaagggaaaaaacagcgcgacttgttaagggacaataatctgacgaaataaggagagatgaaaatggttaacattattcaagactttattccggttggcgcaaataaccgtccaggctacgcaatgacgccgctttacattacggtgcacaatacagcgaatactgcagtaggagcggatgctgcggcccatgcccgctatttgaaaaatcctgatacgacgacaagctggcattttacagttgatgatacagaaatttatcagcatctgcctttgaatgaaaacggctggcatgcgggagacggaaatggcagcggcaaccgggcttctatcggaattgaaatttgcgaaaatgctgatggagattttgcaaaagcaacagcaaatgcccagtggctcatcaaaacattaatggctgaacataatatcagtctcgccaatgtcgtccctcataagtattggtcagggaaggaatgtccgcgaaaattattagatacgtgggattcgttcaaagcaggaattgggggaggcggcagccaaacttacgtcgtgaaacagggcgacacacttacatccatagcgagagcatttggtgttacggttgctcagctgcaagagtggaacaatatcgaagacccgaatcttattcgcgttggtcaagtattaattgtaagtgctccatcgtccgctgaagaacccgagctctatccgctccctgatggtatcattcaattgacaacaccttatacctcaggagaacacgtctttcaggtgcaacgagcacttgcggctctgtatttttaccctgataaaggcgctgttaacaacggaattgacggcgtttacggaccgaaaacagctgacgcagttgcccgttttcagtctgttaacggtttaactgctgacggtatctacgggcctccgacgaaagcgaagatcgcagcgcaattaagctgatcaaagaccataaaaatcccggagccgctccgggatttattttttcttcttcaactttttaataattccagcactgcgctccctcacccgaagcgagtacccggaaagcccaaaccttccgtaatcaacaaacttcacacgcctcaccaattttttcactgtatcacctgacattatcctctgtttgtatttattatatgtaatcctttaagaaaaggaataaggacaagagctttttcccttgtccttttagtgtgatcatgctttttttcgtttatactcgtcaatcagccgttcgttttctttgaagattcttgctgtatgcggactgacttgatagcttgcgacactggtggttgaacgttttttcaggattttaaacggcttcgccgctctgggctcgcatctgttttgaaacgcacgttccattatccttcaccttcctcctcaattggcagcaccaaatcatatatgctcgttaatgacgtaaatagcaaataatcaaattccgtgacaatgctgtcagacgtcagcttgatgacatagttctgtgtctcgatggtaaaagggatgagaaccacttttccgtattggtcgtaataaacatcctttcgatcgagccgtgtttgtacatctgccggatcatccatatgctcggttaaccggtctttatcagcctgtgtcgaatagtggcaaagagaagccgttaagttcattttatcagcataggttttcagcagcttatcaataccttcagcataagcatctatacttccataataaacatggatcggttcgtttttcaataggtattggtatgttttcagccgattgagatacatgtggagcatttcgttgttttcttcaagaatttctcttgtgtctgtttcaagctcgctgccggccagttttttgacgtatgcacttaagaagataaaagcatcaatcaaagcaaaactgactgcgacaatgagataccgttcccagtgggtaaatagggaagtgggctcatatgtccagtataccatagcacccagaacaaacagcaaataccaagttttccggatggcggacattttttctttgaccttcgcttcgaaacgccacgtggcatacacgtataaccccagtccggccacgatgcaccagaccatgatctgaaagaataaaaccatattcgaatccctcacatctgaaataggttctgcttattgtattcgagagatccggatggttttcctgttccatcaaaaaaaccgctcctttgacagaagcggtgtgacattaaaatatcatatttaaaataaagtaggcgatggcaccaagtgtcgctgaaatcggaagcgtgatgacccatgtaatgagcattcgcttggccgtaccccagtttacgccttttacccggtgtgacgcaccgacgccaagaattgatgaagaaatgacgtgggttgtactgaccggcaaatgaataaatgtggcgccgaaaataatggctgctccggttaagtcagcggaaacaccgtttaccgggcggattttcatgatctttccgccaacggttttgatgattttccagccgccgattgatgttccgagacccatggctgtcgcgcaggcgaattgcacccaggtaggaatatcattagcagaagtatgtaaattcgctgtgatgagagccattgtgataattcccattgctttttgcgcatcgtttgttccgtgtgtatacgattgcagggcagctgttacaatctgcactctgcggaattgcttattcgttttcgccaagttgctgtctttgaaaatcagcttaacgatgctataaagaataaaaccaaggacaaaggcaataattggtgatagaatcagtgcttcaatgattttaatgaagcccttatagtttaacgctgcaaatccggctgccgcaatggctgcaccggcaatagcgccgatgatggcatgggatgagctgcttgggataccgtagtaccatgtgataaggttccaggcaattgcagcgagtagcgcagccaaaatgacaacagagccattttccagcgtataaggatctacgatgtctttcgtaatggttttggcaacacctgtaaacgtcattgctccgacaaagttcatcacagcagccaatataatggcatggcgtggttttaacgcttttgttgataccgaagtcgcaattgcgtttgccgtatcatgaaacccgttgatgaaatcaaacgccagagcacaaatgactattagtatcgttaatattaatagaatatccatttttacccctcgttacgcgtttttcataatgatggtttcaagattattggcaacactttgacaagagtcggcgatttcttcaagcgtttcgtatatttcacgatattgaatgactttgattggatctgtttcatttccgaaaagattctttaatgattttctgtgcaagttgtcacaactgtgctcatattctttaattttgattgcgtgaggctgaatatcttttaagcgattttctgccagcagctcgatcgtaatcaaaatctctttcgcacattctctgatatatccgctgaatttatcaatatgctcgtctgatgaagtaattgagaaaatctccatcatggcagagaaatgttcgattccgtcaagcacatcatccaagctgtttgtcagctgaaggatatcttcgcgctcaataggagtgatgaacgctttgttaagctctttaatcatgacatgaacatgattgtcaccttttgtttcatattcctttaacgtatctgcaaattctttaagagtcgtttggttagtgaccttaaaattcacaaaatattctgcagtttcgtctatgttctttgcaatttctgttaaaaggagtgagaacttatctttttttcttcttatcattaaaaaccctccatagtttgaatgaacaatgcacacatcaaattattatatagccttttgtcgaaaaaaaacaggtaaagtcgaaaaaaacgtatcttgacttttttgataaatcgtgtctccttattttgacctacttcgctttaaaaaaacgacccaagtttgcaaaaactttctgcttaacgtaaaaagtatatcaaaagttgtgtttttcctgtcaacttttatcttctgtttcaccaaaaaacggttccctaaacaagggaaccgttttatcagcttgcttttcgttttttcatcccgtaatagacaggcagtccggcaaggccgatgaggatggataatccgcagctcattgtatctgtaatgagtgtgctgcctaacacaaagaaggagcccgcgattgccagaattggcataaatggataaagcggaacactgtaggcgcgcttttctccctttgctcgcttgcggagaataaacactgcaaaaaaggccatcacataaaaaatgtagatcatgaaaatggagatttctgagagcttatcagggttgctgatcagcatcataatcaaagccaaagcaatttgaaaagaaatcgcaatccatggtgtgcggaacgacgggtgtacatgtgacagtttttcagcaaatggaagctgtttgcgttccgccattgcaaatgaaacacgcgggaaagaaagcacctttccatttaagcacccaaagatgctgacgataatccctacactgatcagctttccgccaattgaaccgaacagcatggttgcagcggtgcttgtcgcattttcaccaagcgtgacaatttcgttcgctgacaggatgtgaagcaatgcaaaattaatgaaaatatagatcgccgttacaattaataatccgcccgtcatagcgcgtggcagcagcttttcgggatttttcatttctccgccgagagcggcaaggagaatccatccgtcataagcaaacaacgtagctaaaatagccgccccgaagttcatatcagaaatgctttcgtttactgctgtgaagatgtgctgatcgcctttccaaaggccaaagatgatgatgcaggcaatcggaatcagttttccgatcgttgtcagcgtttggacaaaaccgccgtattttgtaccgataatattaatgacgcataaaaagagaactgctataattccaatgacttttgatagtccagatccccagccgaaaagattcgccattaaagatccaaaatataaacccagcgcgccgataatcgccgggccgtaaatgataatctgcacccagccgcacaaaaatccccaaaactcgccgtacacttcttcaaggtacgtataaagcccgccggtttttggaatctgcgttccgatttccgcgattgtcaaaccgcccgccagtgttaaaataccgcctaacagccaggcgaaaagcgccgtttttgaatcacctgaataagcaagcacagcgccgggcttcataaaaacaccagaaccgataatggttccgatgacaagagtaagggcaaacaagaggcctatctcttttttcaaaccgttgtcttcagtatgcatgtccttaacctcctatgatgttgaagcttcatgttgaagaatctattttttcatattgtaaaccctattttagaaaagtgaaataaaataaattttctgattttcgaaatttgctttgtgtacagcaaataaaactgtaaaaacgcctgttttaacaatctataaacgaataaacttcgtgatttttatttataaagttcgtgttttatgtattaggattttagccggtacagaggggaggtgagaattcagaaaatgaacgaaccttcggtgaagctgatatgttgactttctcatgcgaataaaatactttgttattagaacaataaatatacaattatgatatgatatctcgaaatcgagataaaataacctggagggacacatatgaaagttaacggcattcaccacgtatcggcattaacggccgacgcacaaaaaaacttggatttctataagaaagtattaggattaaagctcgtgaaaaaatccgtcaatcaggatgaaccgacaatgtaccatctgttctacggagatgaagtggcaaacccgggaactgagctgacgtttttcgagattccccgcattgcaccgtttcatgcgggaacaaacagtatttcttctattggattgcgcgttccaagcacagaagccctgcattactggaaagaacgttttgaagagcagcaagtaacgcacagcggtatatccaaaagagctggacgtgacatattggcatttcaagatcatgaagggcagcgacttgtgctgactgctgatgaggaaggaaaaggatatggcctgcctgttaaacagagcggcattccggaagaattttcgtttcgcgggttagggccgattgaactgactgtgccatatgctgaaccaaccttacacgtattaacgaatattcttggatttacagaaatcagccgtgaaccagtcgaagggcaaggaaccgccgttattctggaatcaggagaaggcggtgctgcaacggaaatccatttaatagaaagaaacgatcttccgcgcgagcgtcaaggcaaaggaagtgttcaccacgtcgcatttcgggtaagagatgaagaagaacttgccgggtggcaccggatcattagccgggaaggctttagcaattccggcattgtggagcgctactatttcaaggcgctgtatttcagagaaccgaacggcattttgttcgagttatcaacagacggaccgggctttatggtagatgagaatcttgatgagcttggccaaacgatcgctcttccgccgtatcttgagcatcgaagagctgaaattgaagcgaaattgaaaccgatccaataaattgtgattcatttgccttccggcgcggccggagggctttttttattaccataattaattttgacctaaacagcatgccttattagggaggaaatatcagatgctgattgggagaaatggcttgaaaccctttgcaaatatgggtgattggtatggaatggcctcggcaaaaatattgtctttgtttattaatagtttattcatatttgcttgttacactatttccaagttagacaaaaaggagtgaaaaataagtggaaaagaaaaaacgcgagctggatattttcctcatcctcattttgctcgcatctgcattcttaaatatctataacatctggaatgatgatacggtgaatccttattacaccgctgcagtcacaagtatgatgcaaagctttcataattttttctatgcctcattcgacgcggcgggtttataacggttgataaaccgcccattacgttccagatacaaaccatcagcgcacttatattcggtatgcacggctggagcgtcatcctgcctcaggcacttgctggtgtaggttctgtccttttaatgtatctgttaataaaaccgacattcggtaagacagcagcaagaattgcctctttcatcatggcatgtacaccgattgctgtagctgtagcacgtacaaacaatgttgatgcattactggtatttttcttattgcttgctacatggcttctctttaaagcgatcagaaaaggaaagctgatctggctgttagcagcatttttcgttgttggagtaggtttcaatacaaaaatgctgcaggcttacatgattttaccggctttcttattgttctatctgattgcggcaaacgccacaatcaagaaaaaaatcgtttcattggtaagtgcgttagccgtattagcagccgtttcgttatcgtggccgctcattgtcgacaatatccctgcaagcaagcggccttatatcggaagcagccaaaccaactctgttttggaattggctttcggctataacggaatccagcggctgacaggccaaaattcaggcggcggccagggtgcgccaaacaaagacgcttcaaaagaaatgtcttcttctgataacactcaagcaccgcctaatcagtcatcaagcagcagctcatcaaatgatgacaaatcttcaaatggcaatatggcggcgcctccatccaatggccaaatgccaagcggcggtcaaggaggccctccaagcggcggagatggcggccaaggcggacctggcggagacggagggaaaggcggtacaggaaccggttcgaaaatgcaatcaggttcagggatgtttggaacgggaacacctggtccactgcggcttttccaaacagagttatctgatcaaatcagctggcttctgccatttgcgatatttggaatcgcaggcttactgatcgcaggcgcgagagaaagaagaagattatctatagagcagaaggaaacggtgttctgggttgcgtggcttgtaccgattgccggattcttcagtgtcgcagaatttttccatcattattatctcatcatgctggcaccgccgattgcggctcttgtcggtgcggggtgggttgctcttgttcatctgtaccgcaatcagacaggctggaaagcatggcttctgccgggagcaattattgcgacaactggatttgaattgtttattctcagaaactacaacgatcaaatcggtgttggatggagtatcggggtaggtgttatcggcgcgttgtcagcgattgctttgctgctgtttaaacagcgccaaaaaccgttcagttattatgtttcacttgcagctctcctcgcattgctggtgatgccgatttattgggcaagtacgccacttctgtacggaggcaacagctcactgcctgaaacaggccctcagctcgcatcaatgagcggaaaaggcatgggaatgtctgatgcgactgtaaatgaaaaactgatcaaatatctagaggagaataactccggagctgaatacctattcgccacaaccgattcgaacacagcggcaccatatatcattaaaacgaaaaaagctgtcatggctattggcggatacagcggttctgacccggcaatcacactgactcaattcaaaaaacttgtaaaagaaggaaaagtgaaatacttcttggcttctggaatgggaagaggcggaaacaatgacattgttgaatgggttgagaaaaatggaaaagaagtagcatcagaaaaatggcaatcaagttctgatcaaaaaacaggaaatactgattcgactgatacatcaagcagcaaggcttcaggtgaaaacggcaaaatgggcggacctggcggaatgaatcagtcagcaacattatacgaactacatgctgatgaataggaggcaaaaacatgagcagacatattcaatattcaattgttgtacctgtgtataacgaagagcttgtcattcatgaaacctatcagcgcttaaaagaggtcatggatcaaacgaaggaaaactacgagctgctttttgtcaacgatggcagcaaagaccgcagtattgagattttaagagagcacagcctgatcgatccgagagtgaaaattattgatttttcaaggaattttggacaccagatcgccattacggcgggtatggattatgcacaggggaatgcaatcgtcgtcattgacgccgatttgcaggaccctcctgaactgattttagatatgattgaaaagtggaaggaaggctatgaggtcgtgtacgccgtgcggactaaacgaaaaggggaaacctttttcaaaaaacaaaccgcggctatgttttaccggcttctcagcggtatgacagatattgatatcccgattgatacgggggattttcgtctcatggacagaaaagtctgtgatgaaatgaagagattaaaagaaaaaaatccatttgtcagagggctagtcagctgggtgggctttaaacagacagcggtcgagtatgtacgtgatgaaaggcttgccggagaaacaaagtacccgctcaagaaaatgctgaagctgtcaatggacggcatcacgacattttcacataaaccgctgaagctggcaagctatgcggggattttaatgtcaggtgctggatttctgtatatgtttatcgtgctgtatctgaagctattcacagacagcacgattaccggctggtcatcacttattgtgatccagctcctgttcagcggcattgtccttctgattttgggcgtgatcggcgaatatatcggcagaatctacgatgaagccaaagacaggccgctttacatcgtccaaaaatcgtatggaattgaaaataaaagactctatagagaccagcatatgtcataacctcaaaccccctgtccgtaatggacagggggtttttatgctctgagcacgatctaaagcaaaagatgctgatagatatatggaaattgggtaaagaagagattgtgagcttgtactgcggttcagtcatgctgaaataaaaacagaaaaacttaaagatttcgtcctcggctttgctgcatgtcagctgttatattggagggcttttaagaaacgcatgattagagccgtaccagttatgtttaatagaatactggtacccaatacaattccccacgtcaacgtcgattcagagagaagaaagctcagcaaaagaaaagccaatcctgcgcagatcatacccagtccccacggtttgcatgttcatgcctcctagcaaacgatgtttctagcatctgatgtgaatgatgtcaatctgtatgatatacggatatctcgtcagaaagtttcatagaacaattaggtcttttatctaataaaaagcctcagaccgcttttacggcctgaggcattatgtcttacgaagttttctcttctttttgatccagtttaatttttttcgtcatttctttgccgtttcggagaattttcacttcaacggtatcaccgatctttgcgtctttatataagatattgcgcaattcactgcctgtatcaatttctttaccttttaggccgatgataatatcctccgcttttaatccggccttttcagcaggagagcctgaagcgacctcacggatgtaaacacctttattcagctggctgccgaacaggccgagtgtgccttcttggtaattttgcggcacttgctctagatcaagcatgctgacaccgatatatggacgttcaatttgtcctttagacagcaattcttcagcaatcggttttacgtcattgcttggaatggcgaatccgataccctcaacatcatcctcactgattttcatactgttaatgccgacaattttgccgtctgtatttaacaaaggaccgccgctgttacctggattaattgctgcgtctgtctgaatgacgttaatgctcgtttcgccggctgatgtagacattgaaaccgttctgtccacgccgcttacaattccttgtgttactgtgcgggacagatcttttccaagcggatccccaatcgcaataacggtctcgcctgttctgagatcagatgaatcaccgaagtttgccacttttgtgacgtggtcatcactgatttggaggacggctaaatcagttaacgagtcactgcctaccagctttgcagtaacctcagtgccgtcatataaagataccttcagtgatgatgccccttctacgacgtggttatttgtaatgatataagccttgccattctcttttttgaaaatgacacctgaccctgaaccgctttctgtatcttcgctggaatcagaagaactagagccgaacaaagagctgtttgattgtgcctgaagatttgtaataccgacaatcgctggtgaaaggtcttctaccatatctgagattttagaagagtcctcgctcttgaatgcagatgagctgcttgagcttgatgagctttttttagattcagaggaggtgcttgttgctgtaacagattgcgtttgctgctggctggatgattgttttgcagtgtcctgagaatcatggtcgccaagcggtgtaaacgtgtaaatgccaagggcgagactgccgccgatcactccgccaagcaacggtctgaaccatccgaatcctcgttttttcttctcctgatcatgaatgacattgcgggccgagtaggaggcgctctgattgttctctttcgttaaaaagacctcattctcattacctttcgttctgttttcatcacgatagttatccatcatgttcactccgtttctctattttcacatgtctatttatattgataggtttatgacttgagtttatcataaacaaaaactgtgggataaaaatgaaaagattatgggaaattgtgaaaaagtgcggaaaacggtacacttcatattgtatatgaaaggactgagtcgatggaacagattggattgattggatatggcagcatggcggatatgatcgccagacagctgttgaaacatgaacaaataaaagagaatgagctatttattgagacgagaacgaagggggagcggctgcgggcactcatgtcagattatccaaacgtatcggctgatccgttggagaattgggcaaatacgtgccaattgattttgatatgcgtcccgccgctccatgtcatcgaaacaatgcgccgtctgcacccatatgtgaacagaaatactcacatcgtatccatagctgccggtgtgccgctgcgtcttttggaggcagaaacagaagccggtgtatcacgtgttattcctgccattacgtccgaagcagaagctggcatctcacttgtcgttcacagtgaagcactggctgcggagaagaaagagcatctgaatgaattgttatcggttttcagccgtgttcgagaaattaaagaatcgaatgttgatgcggccagcaatttaacgagctcggcaccgggattcatagctgcaatctttgaagagctggcactgtctgccgtcagaaacagcagcctgtccaaagaagaagcctttgattttctgattcattcgctatacggaactggcaaggtgctgatcgaaaaaaatatgtctttcgaggagacgctggaacgtgtcgcaaccaaaggcggaataacgggagagggagctgaggtgatacgcgcctctgtgccggacgtttttgatgaggtgtttgaaagaaccctgaaaaaatatgaactgcttacagaacaggttggtaaacagacatgaatccttgaaagaggattctttttttatcactgaatgattgagatttttcccagttatattgcatttttcctctttttttaatataatctgttagaatattcataatttagtaaaaaaggaggagcgttatgaaattgtacatgtcagtagatatggaaggtatttcgggtcttccggacgatacctttgtggattccggcaagcggaattatgaacgcggacggcttatcatgactgaagaagcaaactactgtattgctgaagcgtttaacagcgggtgtaccgaggtgctggtcaatgacagtcattcgaagatgaataatctgatggttgaaaagcttcaccctgaagcagacttgatttctggtgacgtcaaaccattttcaatggtggagggactggatgatacgtttacaggcgctttgtttctcggttatcatgcgagagcctcgactcctggtgtcatgtcacacagcatgattttcggcgtccgtcatttttacataaacgatcggcctgtcggtgagcttggattaaatgcatacgttgccggttattatgatgtcccggtattaatggtagccggggatgaccgggcggcgaaggaagcagaagagcttatcccgaacgtgacgacagccgcagtcaaacaaaccatttcaagatccgcagtgaagtgcttgtcgcctgcgaaagccggacggctgttgacagaaaaaaccgcatttgccctgcaaaacaaggacaaagtcaagccgctcacaccgcctgacaggccagttctgagcattgaattcgccaattatggccaagcagaatgggcgaatctgatgccgggaacggaaatcaagacgggaactacaaccgttcaatttcaggcgaaggacatgcttgaagcctatcaggcgatgcttgtcatgactgagcttgcgatgcggacatcattctgctaaaggggtgttttaggctttggcgcgatacatgataaagcgtttttgggcaatggcagctacgattttggtgattaccaccctgacttttgttctcatgaaggtcattcccggatctccttttaacgaggagagaggcacaaatgaagccgttcaaaaaaatctcgaagcctactatcacttagacgatcctctcattttccaatacattttctacttaaaatccatcattacattcgatttcggaccttcaattaaaaaaccgtcggacagcgtaaatgatatgctggaacgcggatttcccgtttcctttgagcttgggatgacagcgattgtcattgctgtgatttctgggctggtgctgggcgtaatcgctgcactccgccgcaatgggtttttggactacgccgcgatgagtcttgcagtactcggcatctccatcccgaattttattctggcaacattgctcattcagcaatttgctgtcaatctcaaactatttcccgctgcgacatggacgagtccgattcatatggtgcttccgaccgcagcgcttgctgtagggccaatggcgatcattgccaggctgacacggtcgagcatggtcgaagttctgacacaggattatatccgcacagcaaaagcaaaagggctttctccgttcaaaattatcgtaaaacacgcactcagaaatgcactcatgcccgtcattaccgtcctgggcacactcgtcgccagcatcttaacaggaagctttgtcattgaaaaaatctttgccattccgggaatgggaaaatattttgttgaaagcattaatcagcgggactaccccgtgattatgggaacgaccgttttttacagcgtcattctgattatcatgctgtttttggtcgatttggcctacggtctcttagacccgcgcattaaactgcataagaaagggtgaagcgtgtgaatctccctgtacaaacggatgaacgccagccagaacagcacaatcaggtgcctgatgagtggtttgtctcgaatcaggaaaaaaatcgggaagccgattcggtcaagcggccgagtttgtcatacacgcaggatgcctggaggaggctgaaaaaaaataaattagcgatggccggactctttattcttttatttctttttgtcatggcagttatcgggccctttttatcgccccatagtgtcgtacgccaatcgctgacagaacaaaatcttccgccctcagccgatcattggttcggcaccgatgaactcggccgggatgtgtttacccgaacatggtatggcgcgagaatctcgttgtttgtcggcgtgatggcagcactgattgattttttgatcggtgtcatttacggaggcgttgccggctataaaggcggcaggattgacagcattatgatgcggattatcgaagtgctgtacgggctgccgtacctgcttgttgtcattttgctgatggtgctcatggggccgggactgggcactattattgtggcgcttactgtgaccgggtgggtcggcatggcgagaattgtaagaggccaggtgcttcagattaaaaattatgaatatgtactcgcctcgaaaacctttggcgcgaaaacctttcgcatcatccggaagaatttgctgccgaatactatgggagcgatcatcgtacaaatgacattaaccgtacctgccgccatattcgcagaatcatttttaagctttctcggcctcggcatacaggctccgtttgcaagttggggcgtgatggcgaatgacggcctgcctacgattttatctgggcattggtggcgcctgttttttccggcctttttcatatctctgacgatgtacgcgtttaatgtgctgggggacggattgcaggatgcgcttgaccctaagctgaggaggtagctgtatgaaaaaagttctgtcagtccaaaatctgcacgtgtcttttacgacttacggcgggacggttcaggcggtcagaggggtgagctttgatttgtataaaggagaaacctttgcgatcgtcggcgaatccggctgcggcaaaagcgttacctcccaaagcatcatgggcctgcttccgccttattcggcgaaggtgacagacggcagcattctatttaaaaacaaagacctttgccgtctctctgacaaagaaatgagaggtataaggggagccgacatttctatgatttttcaagacccgatgacggcgttaaaccctacgctgactgtcggcgaccagctgggggaagcgctattgcgccacaaaaaaatgagcaaaaaagcggcacggaaagaggtgctttccatgctgtcattggttggtattccagatcccgaagagcgcctaaagcaatatccccaccaattcagcggcggtatgagacagcggattgtcattgcgatggcgctgatttgcgagcctgatatcttaattgcggatgaaccgaccaccgccctggatgtaaccattcaggcacagattttagagctgtttaaagagattcagagaaaaacgaatgtgtctgtcattctgattacgcacgatttaggggttgttgcccaggtagctgacagagtcgcagtcatgtatgccgggaaaatggcggaaatcggcacaagaaaagatattttttatcagccgcagcacccatatacaaaaggcctgctgggctctgtcccgcggctggatttagatggcgctgagctgaccccgattgacggaacgccgccggatttattttcgcctccgccgggctgcccgtttgccgctcggtgtccgaacaggatggttgtgtgtgacagggtgtacccgggccagacgatcagatctgactcgcacaccgtcaactgctggctgcaggatcaacgagcagagcatgcggtgctgtcaggagatgcgaaggattgaacatgaaaagggggaagaggatgaaacgagtgaaaaagctatggggcatgggtcttgcattaggactttcgtttgcgctgatggggtgcacagctaatgaacaggccggaaaagaaggcagtcatgataaggcaaaaaccagcggagaaaaggtgctgtatgtaaataatgaaaatgaaccgacttcattcgatccgccgatcggctttaataatgtgtcatggcagccgttaaataacatcatggaggggctgacgcgtcttggcaaagatcatgagcccgagccggcaatggcggagaaatggtctatttcgaaagataataaaacttacacatttacgattcgggaaaatgcgaaatggacaaacggagatcctgtaacagccggagacttcgaatacgcgtggaagcggatgcttgatccgaaaaaaggcgcttcatcggcattcctaggttattttattgaaggcggcgaagcatataacagcgggaaagggaaaaaagacgatgtgaaggtgacggcaaaggatgatcgaacccttgaagttacactggaagcaccgcaaaaatatttcctgagcgttgtgtccaatcccgcgtattttccggtaaatgaaaaggtcgataaagacaatccaaagtggtttgctgaggcagatacatttgtcggaaacggcccgtttaagctgacggaatggaagcatgatgacagcatcacaatggagaaaagcgacacgtattgggataaagatacagtgaagcttgataaggtgaaatgggcgatggtcagtgacagaaatacagattaccagatgtttcaatcaggggaacttgataccgcttatgtccctgctgagctgagtgatcagctgcttgatcaggataacgtcaatattgttgaccaggcgggtctctatttctatcgatttaatgtcaccatgaagccgtttcaaaatgaaaacatcagaaaagcctttgcgatggctgtggatcaagaggaaattgtaaagtacgtcacgaaaaataatgaaaaaccggcgcgcgcctttgtatcgcctggatttacacagcctgacggcaaagatttccgtgaagcaggcggagacctgatcaagcctaacgaaagcaaagcgaagcagctgctcgaaaagggcatgaaggaagaaaactataataagcttcctgcgatcacgcttacttacagcacaaagccggagcataaaaagattgccgaagctattcagcaaaaattgaaaaatagccttggagtcgatgtgaagctggccaatatggaatggaacgtatttttagaggatcaaaaagcgctgaaattccaattctctcaaagctcatttttgcctgattatgcggaccctatcagttttctggaagccttccaagcgggaaattcgatgaaccgcacaggctgggccaataaagaatacgatcagctgatcaaaaaggcaaaaaatgaagccgatgaaaaaacacggttctctcttatgcatcaagctgaaaagctactcatcgatgaagcgccgatcattccggtttatttttataatcaggttcacctgcaaaatgaacaagtgaagggaattgtccgtcaccctgtcggctatatcgatttaaaatgggcagataaaaactgatggaggtgattgaggaaatactgcttctttatgcgaaggagcggtattttttctctttcttgcacgtatacgtagggtgcagagcaaatgaaaggagtgttttcgttgaattacaagccgaaagcgctgaaaaagggtgatacagtcggagtgatcgcgcctgcaagtccgccggatccaaaaaagcttgacaccgcgcttttatttttagaagagctcggtcttcaggttaagttgggcaaggcactgaaaaaccagcacggctatttagcgggacaggatgatgagcggctggcggatctccatgagatgttcagagacgatgaggtaaaagcagtgttgtgcgcatgcgggggttttgggacaggacgtatcgccgcgggcattgatttcagcttgatccgcaaacaccctaaaatcttttggggatacagcgatattacgtttttacatactgccattcatcaaaacacaggtcttgtcactttccatggcccgatgctcagcacggatattggccttgacgacgttcacccgctgacaaaagcgtcatataagcagctcttccaggagacggaattcacctatgcagaagagctttctccgctgaccgagcttgttcctggaaaagcggaaggcgagcttgtcgggggaaatctgtctttgctgacgtctacactgggcacgccatttgaaattgatacgagaggaaagcttttgtttattgaagatattgacgaggagccttatcaaatcgaccgaatgctgaatcagttgaaaatggcggggaagctgacggacgcggccggaattctagtttgtgattttcacaattgtatcccggtgaagcgagagaagtctctctcgcttgagcaggtgctggaagactatattatttctgcgggcaggcctgctctgagaggatttaaaatcggccactgctcgccaagtattgccgttccgatcggtgcgaaagctgctatgaatacagcagaaaaaacagtcgtaatagaggcgggcgtttcagaaggggcgctgaagacatgaaaatcattcgaatcgaaacaagccgaatcgccgttccgctgacaaagccatttaaaaccgcgcttcgcactgtgtatacggctgaatcagtcatagtaaggattacttatgacagcggtgcagtcggatggggagaggcacccccgacgttagtgattacaggagacagcatggatagcattgaaagtgccattcacaatgttttgaaaccggcattgcttggaaaaagcctgtccggctgtgaggccgttctgcacgacatccagcatcttcttacaggaaatatgagcgcgaaggctgctgtagaaatggcgctatacgacggctgggcgcagatgtgcgggctgccgctttatcaaatgcttggcggatatcgagatacgctggaaacagattataccgtcagtgtcaactcacctgaagagatggcagctgatgccgagaattatctcaaacaaggctttcaaacgctgaaaataaaggtcggaaaagatgatattgcaacagatatcgcccgtatccaggaaatcagaaaacgtgtcggatcagctgtgaaactgcgtttagacgctaatcaggggtggaggccgaaggaagcggtaactgccattcggaaaatggaggatgcgggtctaggcattgagcttgtcgagcagcctgtccataaagatgatctcgctgggcttaaaaaggtgacagatgcaacagatacgccgattatggctgatgaaagtgtttttacaccgcggcaggcgttcgaagttctgcaaacccggagcgcagacttgatcaatattaaattgatgaaagcgggcggcatcagcggagcagagaaaattaatgccatggcggaagcctgcggggtggagtgtatggtcggcagcatgatcgaaacgaagctgggcattacggccgcggcgcattttgcggcaagcaagagaaacatcacgcgctttgattttgacgcgccgctgatgctgaaaacagatgtattcaaaggcggcataacatatcgcggcagcacgatttcgatgcctggcaaaccgggcctcggaatcatcggggctgcgcttttgaaaggggaaaaagagcaatgatgcacactgtcatatcagcagtggccaacatctggacagcgcctgattcacctcgtccgtctgatcaattcatgcttcaaccgactgtaatgatcagagactggctcgagcgcatgacgtatgatgaacggcttggattatgtacagacaatgtaatccaaactcaggttctctttggcgaaaaggtacttgtgacggcggaacaggggaatgggtttctgtgatcgtgcctagccagccatcccgaaaggatccgcgcggatacccgggctggatgaaaaagtaccagctggaaaaaacaaagcccatccatacacaacacgatgtgatgatcagcaaacctgctgcctttttgtacagaagcaatggggaaaaggagatcgaattaagctttttgacggttctccacctcattgcaaaagaaaacggatattttaaggtttcgaccgtttttggggaaaggtttgtgaggcaaagtgatgcagtgcctgtcagccaacagaaagggactgctgaagacatcattcaaacgggtgcgttttttcttggccttccctacctgtggggagggatcagcgggtttgggtttgattgctccgggtttatgtacagtatatttaaggccaatggataccgcatcccccgtgatgcgggagatcaggctaaggcggggaaggatgtcccgcttgatgatatgaaggctggtgacctgctgttttttgcttatgaggaaggaaaaggagcgattcatcacgtcggtctctctgttggcggcgggaaaatgcttcattctccaaagacgggaaaatcaatcgaaatccttacattaaaagaaacaatctatgaaaaagaactttgtgcggtgcgccgctgtttttcagaataaggagggagacaaatgacgccactgcctttgttagaggtcagcaagctaaaaatgcattttgacgcagggaaaaagcggacagtcaaagccgtcgacggggttacctttcagattcgtgaaggagaaacgttcgggctagtcggggaatcagggtgcgggaaatcaaccttggggagagtgctgatgcgcctctatcagcctacagaaggaagtgtggtataccgcggcacaaatcttcatgtactaagtgaaaaagagcagtttgccttcaaccgcaaactgcagatgatttttcaggacccctatgcttcattgaacccgcgcatgaccgttcgagaaattattttggagccgatggagattcacaatctctacaatacccataaagcgcggcttctcgtcgtggacgagctccttgaggcagttgggcttcactccgattttggcagccgttatccgcatgaattcagcggcgggcaaagacagagaatcgggattgcgagagcactgtcgctgaatcctgaatttatcgtggcggacgaaccgatttctgctcttgatgtctcggttcaagcgcaggtggtcaatctgctgaagcggcttcaaaaagaaaaagggctcacatttttatttattgcccacgatctttcgatggtgaagcatatcagtgacaggatcggtgtcatgtacttagggcacatgatggaaattacagagagcggcactttgtatcgtgagccgctacatccctatacaaaggcgcttttatcctcgattccgattccggatcccgaattggaggacaagcgtgagcgtattctcttgaaaggggagctgccgagcccagtcaatccgccgagcggctgcgtgtttcggacccgttgcccggaggcgatgcctgaatgcggggaatcccgtccccagcttcaagaaatcgaacccggccgctttgtcgcttgccatttgtatcgaactgctgaaacgaaggaaaaagtgagataaataaaaagagtggctcctttttactagagccactccatttgattatacttgatgtaaaaactttacacaaaccgggtaagggacagaaaccgttgatgggaggagtgtcaatcggccggtttctttgtctctttcaaacaagacaaggttgcctgtttcttcatttgaagcaacgaggaacccttccgttgggtcaaatacaaagtcacgaggccagtttccttctgtcgacactctttctacgaaggccagctctcctgaatattgattcacttcaaatacggcgatactgtcatggccgcggtttgcgacataaacaaaacgtccgtcctgcgtgacatgaattgcgcttccctggctgttatctgtaaaatcatcagggatggcagaaacgacttggatttctctaaattcgccggctgtcgggttgtattcaagcgcaatcacttcattgcttaattctgtcatgacataagcgtatttttctttcggatgaaaagcgatatggcgaggtcctgcaccgggagcgaaggaatggcttccggattcagtcaatacgccgtctttcatcttataggtgtacagcttatctatacctaaatcaaccgctaccacataattgtgttcaggtgtgaaccccgcgtagtgtgtatgcggtttttcttgtctttcgtgcggccctcttcctgtgtgagcggcctctgaaacaggtgattgcaaactgccgtcttcctgaaccggaaaaacgtgtaccttcccgctgtgataattggcagtcagtacgaattgattttgatcatcaacgcttacgtggcatggcgaagggccatcaattaactgatgattcagaaatgtcaattcgccgctgtttttatcgatttgataggcagcaactccgccttggccgtctgctttttcgatggagtaaaggatggtgttgtttttattcggcgccacatatgtcgggttgcccagcttagcggccagctttggctcgctcaatgcttttttctcagtatcaagctcaaatgaataaattccttcgcttccgccttttgtatatgttcccacatatcctatgtattttgtcatgcgatttcccccttaaaaatgatgtcacctctatattaacgtatcttgctaaaataagctgttcaaaacatgaaaaaggggaagattcttcaatcgcctcgaatcagcggcattgtgcagcacctgaaggagccgcccgatttaataatttctgacaggtcaatttcgataatgtgatagcctcttttcgatagctgttgattgacatggcggttgccagggagactgatgatcgtttttttttcgattgaaaggacgttggtgccaagcgtaaattgttcgtcctcgggcacctcaataagatcataacgttttgccagcatatcggctgcctttggctcaatggcttgtggataaattaacgcttcgctttcagatacaatgttaaatacgcagtccaaatgcaaaaatttttcatgcagcttcactggaacgatcgtgtattcaggaagtgcctcttccagctggccgatagctgaaatgtcggtgcgctggctgattccgacatagacaatgtcatcatcgataatgacgtctccgccttcaatactcgtatcaagcatgcgggtgtaagagataccttggctgtgaaaaaaatcttttataacggcttcttctccttggcgaatcggttcagtcatgctcgacagaaaggctttttctccgatgacaaaccctatatccctagtaaaaacctgttctgggagtccgtcgcgaacgggcaaaaggacgacctcaacgttgtgtgacctaagtgcctccactaaacggctgtgctggtcgttggcggtttttacatgaatattgtcatcttcaaaatgtttttgtgtttcgtttataacatcttttatggtcatgtgctcaggtttgcataagatcactttctgaagtgtgccgtattccgttcggcatactgttttgtgctgagttttcgggatggatacgtccatttgtttttcctcctaaagtgtgaagaatacatttattattccctcatcatgaaaatcattaaaccattttaaattttagacaaatggaagagaatattgtttaataggagaatataagtgcatttagctaaaagatcagacatcaaaggggagaaaggtatggaaacaccggaaacaagattttgtaaagagtcaaaggttgtaaaaaccagcagggtgttcccgcttgacacgaacaaccataatacgctgtttggcggaaaattaatgagctacatcgatgacattgcctctatttccgcggcgcgccattgcagacgtgaaaccgtaacggcttcaatggattctgtagattttttaaagccgatcgggcaaaaggattctgtctgcctagagtcatatgtgacatgggtcggcacatcttctatggaagtatttgtgaaagtcattaaggagcatttgatgactggcgaacgggaactcgctgccacatcctttttgacatttgtcgcattagattcaaatggcaagccggtgcctgtgccgagagttgtaccggaaacagaagaagaaatcatgcttcataatacagcagtacagcgcgctaatgaacgaaagaaccgcaagaaacacagccaggcgcttgcaaatgcgctcggaactgataaaccttggtgacgttaaacccaaaacataagttgttttgggtttttttgtacttttcaatggtgattattacaatggttagtccgtttttgctaggggattctataaaaaagtaacaaatgtcatgttaaattgataattttgtgacaactttattaaagattcattttagatatatcttttattcctaagatcatgtattttaaagatatattctaaatacatcttttcgaaaggattgtttatacaatgttagataacaaaacaatcgaaattattaaaagcactgtacccgtattgcaacagcatggagaaacaatcactggccgtttttacgatcggatgtttcaagaccatccagagcttttgaacatttttaatcaaacaaaccaaaagaaaaaaacacagcgaactgcactggcaaatgccgttattgcagctgcggcaaacattgaccaattaggaaacatcattccggttgtcaaacaaatcggccacaagcaccgcagtatcggaattaagcctgagcactacccaatcgtcggtaaatatttactgattgcgattaaagatgtattgggagacgctgcaacccctgacattatgcaggcatgggaaaaagcgtatggagtcattgctgacgcgttcatcggaattgaaaaagacatgtatgaacaggctgaagagcaagccggcggctggaaagagtataagccattcgtaatcgcaaaaaaagagcgggaaagcaaagaaattacatccttctatttgaaaacggaagacggcaagccgttacctgaattccaagcagggcaatatatcagcatcaaagtgcggattcctgattctgaatatacgcatatccgccagtacagcctgtctgatatgccgggaaaagactattatcgaatttccgtgaagaaggatggtgtcgtgtcttcctacttacacgatgggctgcaggagggagattcaatagagatcagcgcaccggcaggggactttattttagatcctgcatcacaaaaagatctcgttttgatcagtgccggagttggcattacaccaatgatcagcatgctgaaaacatctgtttccaaacagcctgaacggcaaattctgttcattcatgcggcgaaaaacagtgaatatcatgcattgcgccatgaggtagaagaagcagcaaaacattctgctgttaaaacagcatttgtgtatcgcgagccgacagaggaagaccgtgcaggtgatctgcattttcatgaaggacagattgatcagcaattcctcaaagaactgattgccaacacagatgcggattactatatttgcggttcaccgtcgtttattacggcaatgcataagcttgtatcagagctcggatcagcgccggagtctatccattacgagctattcggtccgcaattaagtttggcgcagtccgtttgaacacatacatgaaactcttctcctttcagagaagagttttttattgagatataagtaggtagacaaacgccggtttctacatccggacaatcacagacccgccgccatttgtgcatacacggttttgctgttcttgcattgttctcagcaattcattgtttacctcaatcgctctaattagttgctccatccttagctccaaaccggccagcctgtcgattgtttgctgctggtagcccgtgggttgggaagccaatggcagctcaaagggccaaagggtattcgacttctgatttttcatattgcgtattgcgcctccaatcggtgtcactttctattatgttatgttcaggcgaggtgcacgttcgcctatttagacactgatgcatagagggcctgccaaggggcacaataggctcaatatgaccagcggatggaggtaaagatcggtgttatggatgatatgggtatttttactgaagccagttatcgtattttcgattgcatatattttatttcggcttgccggtaaaaaagctgtgtcacaaatgaacaattttgatctgcttttgaccttcgcaatcggaaccattatcagtgagccgatccttacatccaagctgccgatgtcaatttattatgcgggtgcttttttggtgctttatcttatcatgagcaagctctctttatctaataaatggcgatggctcctagtcgtgagcccgactgtccttatccggaacggggatattgatgaacgcggccttcgtaaagaaaggctgactgttaatgaactgctcggaaagctgagggaaaagggctatgccgacccggctgacattgatcttgctatcattgaagaaacgggagaagtaagcgtcatcccgaaagaggaagcgagagcggtacaggtgcgggatttgaatatggaagctgaacggaattttatcccgattccgctcatactggatggcgaaatccttgatcataatttgaaatatctccaaaaaaaccgatcctggctgtttgagaagcttgaggaaaaagggtacagccccaaactgctgtcttcgatcaccttaggcacgatgaatgcgcgaggtgatatatcccttgatttaaatacctctaatgacccgcagcatgatccttacttatataaaccgggaaataacaattaagatggctctctcttgtaatgagagcttttttcttttttaaagggaatttttgtttggtgtcaaatgtacctagttaggaggggaactgaacatgaaggacttatccataagaaacgacatggcgccaacggttagtctgctgtattccgcagtggaagaaaatagtctccgtctggcttctatcgtaagccatatgacacacagtgaactttactataaggggcgctgccaaataaaaaacagcacggctcagcttttgcaccatatcacaaatgttgatatcagatgggtctggcgtatcaaggaaaatcggatacctaaccatattgaacaggcatacggccccatgacagatgaaagcggacggctgcctgaaccggtgaatcagccagacttagatgaactcctgaaaagacatcagcatgtagtagacgagctgaaatcggtatgcttcactttaactgaaaatgctttgaaccagccgctttctttcgaaggtgacaccgcgacgatacgatggggaatttggcatatggcagatcataaccgctatcatcaggcacatattgaagctctcaaaaaagaatggaagcaggatgtggcgaagtatgaacgctaaaacgaagcttgtgaccgatcgaattcgtttgcgctgtatggaagatcgggatcaagccaatttgtttaggctgctttttaatgatcctgacgtcatgaaatattattccgatttaaaagataagaggcaaacccgcgagtggatcaattggaaccaacgaaatgaaaaagggtacggcgttagtctgtggatcgccgaagataaccggacaggggagtttttggggcaatgcggcatcgttccccagcagatcgaaaatcaaaccgtaatggaaattggctatatgtttgcccgccgccactgggggaacggctatgcgcaagaagcggctcgggcctgtctggactatggctttaacgagcggcagttcggcaaaatggcagctttgattgatccgggtaacaaagcgtccatacgggtagcggagaaaatcggcatgcattacagcaaaacgaccagaaaatggaataaaccgatcgcggtatatgaaagaaaatcttacaattgaaagatagagctgagtttagtatcatgatatcatgtaaagttttctagggttccgcatgtcaattgacatggactggtccgagagaaaacacgtacgcgtaaatagaagcgcgtatgcacacggagggaaaaaagcccgggagagtcaatctcatgtgagacgactgtccggggttttttgttttcggagaatcctaatagatagaaaggaatgactcaaaatgaaatggggattggtcgtgcttgccgctgttttcgaggttgtttgggtgataggcttaaagcacgctgactcagccttaacatggagcggcactgccatcggcatcatattcagcttttaccttctaataaaggcgactcacattctgcctgttggtaccgtgtatgccgtctttaccgggctcggcacagcgggaacagtacttagtgaaatcgttctgtttcatgaaccgattggatggccgaagctattgttaattggcgtgctcttaatcggtgtaatcgggttgaagcttgtgacacaggatgagacagaggaaaaaggaggcgaggcataatgctgcactggatcagtttactgtgcgcgggctgtttagaaatggccggcgtggcccttatgaatcaatatgcgaaagaaaaaagcgtgaaatgggtgctgttgatcattgttggttttgccgcttcattttccttgctgtcgtacgcaatggaaaccattccgatgggaacggcttacgcggtctggacaggaattggcaccgctggcggggcgcttgtcggcatcctcttttacaaggagcagaaagacgccaaacggatcttctttatcgcgttgattttatgctcagcggttggtttaaaaattctgtcataaattgatttttatcaaatcttcagtataatggataaatagtttagacttacaaagataagagggattattcatgaaatcatatatgactcagcggttggacgaataccgtgacggaaatgaggataaagggcggctcttggtcagctgccccgatcagccgggtatcgtctctgcagtttctgcgtttttatttgaacacgatgccaatattatagaatcaaatcaatatacgacagaccctgaaggcggccggttcttcctgagaatcgaattcgactgcgcgggcattcgtgagaaaaaagcatctcttcaggcggcgtttgcctctgtagcggaaaaattcgacatgacatggagcttaactttggcaagtgaattgaagcgtgtcgccatttttgtttcaaaggagcttcattgcctgcatgagctgatttgggaatggcaaaccggcaacctgatggcggagatcgctgttgtcatcagtaaccatgaggaagcgagagagctggttgagcgcctgaacattccattccactatatgaaagcgaacaaagacatcagagcggaagtcgaaaagaagcagcttgaactgctggagcagtacgatgttgatgtcatcgtgcttgcacgctatatgcagattctaactcctgattttgtttcggctcatccgaatcgcatcatcaatatccaccattcatttctgcctgcttttatcggtgcgaatccgtacaaacgggcttacgagcgcggcgtgaaactgatcggtgcgacatctcactatgtgacaaacgatcttgatgaaggaccgatcattgaacaggatattgagcgtgtggaccaccgcgataatgcggaagcgctgaaaaacatcggaagaacaattgagcgcagcgtgcttgcccgtgctgtgaaatggcatttggaagaccgtgtcatcgttcatgaaaataaaacaatcgtctttaactagactgaaagaggcccgcgcaaagcgggctatttttgatgacaaaaaaccttgacaagtgtcttttttctttgcataatataaaaaaatcattgagcgttgaagaggattagtaagcagatctttctgtgacagagagcaaaatgaatcgctgaaacattttgccgcatgaaacctgccgaacctgccttggagtcctagggggaaaacctaggcgcataacctggcgttacaggagagcggagcgtgcacaagcgcgttcaatcaaggtggtaccacggaaacccatttcgtccttatgaatcaggatgaaatgggtttttttattgtagaagagccgcggaggagaataaatgaaaaaacaaagaatagtagtgaaaataggaagcagttcgctcacaaatagcaaaggaagcattgatgaggcaaaaatcagagagcatgttcaggcgatttccgtgttaaaaaaagcggggcatgaaatgattctgattacctcgggtgccgtagcggcggggttttccagcctcggatatccgtcccgtcccgttaccatcaaaggaaaacaggcggcggccgcggtcggacaaacactgttaatgcagcaatatatgaatcaatttaaacaatactcactgactccgggacaaatccttttaacgagaaatgatttttcgaaaagagaacggtatcgaaacgcgtatgctacgataatggaattattggaacgcggcgtcattccgattatcaacgagaacgattctacatctgttgaagaattgacattcggagataatgatatgctttctgcgttagtcagcggattgattcacgcggaccagctcatgattctcaccgacattaacggactgtatgatgccaatccaaatgaaaatcctgaggcgaaacgatttgattatttgccggagatcacgcctgaattgcttggatatgcaggttcagccggatcaaaggtcggaaccggcggaatgaaatcaaagctgttagccgcacaaaccgcgctgtctctgggagtgaaagtattcattggaactggcagcggagagcaaaaacttgcggacattttggacggcaggggagacggcacttatatcggagacaaagaactatcttcggttaacaacacaaggcagtggattcagttccactcgccgatatcgggagaaattatcattgatgcgggtgccgaggaggcgataatccataatggaagcagccttttgcccgctggcgttgtgggtgtgaacggaagctttccgaaaggggcggttgtggaagtcaggggaccgggcggcgtgatcggcaaaggccaaacccattactcctctgaggagattatggaagccaaaggcaaacgcagtgacgaacttgattttgagaaaacgtttgaggttattcataggaatgactgggtcaatgtaaacgactaggaggcggaaaaatgagtgaagtttctgtaaaagcgaagctggcgaaagaagcagcagccgaaatgatcatgaaaacaacagccgagaaggatgaggcgctcagcctcattgcaaacggactccgcaaagaacttgattttctcttggcggagaatgcaaaagacattgagaacggaaaagagaatggtttaacaccggacatcattgaccgtctcacattggatgagaaacggatacgcgatatcgcggacgcggtggagctcttaatcgacttagcggacccggtcggcgactctcttgaaacgattgaaaaagaaaacggcctgtttattgaaaaaatccgtgtgccgctcggtgtcgtaggaatgatttatgaggcgaggccaaacgtcacagttgatgcagctaccctttgcctgaagacagggaacgcggttgttctgcggggaagctcctcagccatccatagcaacaaagcgctcgtcagtgtcattcacagagcacttgagcaatcagcgcttccgattcacgctgtgcagctgattgaggatacgagcagagagacagcaaaagagctctttacgttaaatgatggtttagacgtattgattccgcgcggaggcaagaaactgattgatctcgttgtgagagaatcaacagttcctgtactagaaacgggagcaggaaactgccacatattcattgacaaaacagccaaaccgcaaatggcagaaaaggttgtcgtaaatgccaaaacgcagcgcccttctgtatgcaacgcgattgaatcattgctgattcacaaggcttgggcgagacagcacgggaaagaattgctggaccagctggaaaacgcgggagttgaaattcgcggtgatgaattggtatgtgaacttcatccttcaagcaaacaagcatcaaaagaagattgggaaaccgaatttttagcgcctgtcctcagcgtaaagacggttgaaaacgtccgagaagctgtaaagcatatccaacaatacggcaccaatcattctgaagcgattttaactgaaaatgacaaaaacgcggcatattttcaaacggctgtcgatgctgccgctgtctatcataacgcgtcaacccgctttaccgacggctttgaattcggctacggagccgaaatcggcatcagcacgcaaaagcttcatgcaagaggaccgatggggcttcctgcactgacttctacaaaatacatcattaaaggaactgggcaaatccgtgaatagcggggcaatgttcaatgaaaaagcttatctcgtaatgagataagcttttttatacgtgaaaaattgacataccaaaattaattgtgtacaatttaattgtataaaatatattgggggaatgaaaaatgagtcagccattatttacagcaactgtttcagcggtaggaggaagagaaggaaaggtcatttcatcagaccgcgttcttgagcttgatgtcgcaatgccggggacaccgagagccaagaaattagaaaaagcgacaaatccagagcagctgtttgcagcaggttatgcagcttgctttgacagcgcattgcagcttgtcgcaagaacagaacgggtaaaagtagagacagaggttacagcgaatgtaagcctgttaaaggatgaagcggaccagggctacaagctgggtgtgacactgcaggtaaaaggagaaggagtcagtgcatcagaattggaggcgcttgtgaaaaaagcgcacggcgtctgcccgtattcaaaagcaacctccggaaatatagatgtgacacttgaggttactgaataaataaaaagaggatgccttgtacaaggcatcctcaatttttttgatgaagtgtttccagcaatgtatatagagcggactttaactgtttgagatcctccccagactgctttgagagccccagaattgtctctggaatgtcaaccgctttttcttttaataacgctccgtcctctgtcaggctgatcaacacggaccgctcatcctcttcagatctttttctcgtaatcaaaccctgttgttccattcgtttaagcatcggagtgagcgtccctgaatctaaatacagctgttcgcccatttttttgacagtaagcgtttcatgttcccataacaataacaaagccaaatattgggggtatgttatattcagcttatcaagcagcggcttgtattgctttgtcatttcccgcgaactcgcatatagcaaaaaacaaagctgattctccaatttcatatgatcaaatttattttccattttgttcaccaactctttttgtcattcgattctattgtatctgaaaaacctcacttttcctattctcggcaaacatagcatgtttaaaaagatcagaaagggaaatataacaactagatacaaataaggaggttgggaaatatggcactatttacagcaaaagtaaccgcgcgaggcggacgggcaggacatattacatcagatgacggtgttcttgattttgatattgtcatgccaaatgccaaaaaagaaggacaaaccggcacaaatccggaacagctctttgcggcagggtatgctgcatgctttggcggcgcgctcgaacacgtagccaaagagcagaatatcgaaattgattcggagattgaagggcaggtcagcctcatgaaggatgagagcgacggcggctttaaaatcggtgtcacacttgttgtgaacacgaaagatttagatcgggaaaaggcacaagagcttgtcaacgccgctcatgaattctgtccttactcaaaagcaaccagaggaaatgttgatgtaaaactagaattaaaataatgaccggcatcctgagtgttctcaggatgttttttggtgtcggagcgggtgtgatcttttcgaagtctgagacatttcttataaatggatttagacttatatccattatgaattgacgcggaacggggtaggggtgggcacagaaattgataaaacgtcagagaagcgatcacagcgtttaaagcctgcaaaagttacagatgaagggggcggctggctcggtgtctgccaagctgaattccggcgcgcataattgctgttttgtatttgcacagggcatagcgctacttggagaaataacaaggaccaggccgcgcatgcctgatccttttaatattctttcttattggcgaagttccgccatgcttgaaaaggggataaatgctctgttagtgtcacttgataaaaggggatcgttctttcttcatcaggtttatcaatttctttataaatgaatgaatcatcaaacccggcttcggcagcgtctgtgtgctcagctgcatagaaaacggctttaggccgggcccagtagatagcgcccaagcacattgggcatggttcacagctcgtatacaaaatgcagtcatcaagctggtatgctcctagcaccttacaggcttttcgaatagctgtgacttccgcgtgggcagtcggatcattgcttgttgtgacgttgttctgtccctctgcaataatggctccgtctttcacgataacggctccaaaaggcccgccgattcctgcattcactccttcacatgcgagagtgacagcccgttttaagaacgtttcatgattcatcccaatccctcctgtcaatagagtgttattagtatagccgaaaaaaatgcaaagaacattcttaaaaaagtgcaaaataaacaaagtaattgggggatttgctaaaataagaaactattgtggctgtattatagaaaaaaaccatctgccaaatgcagatggttttttcaaattatactagctgtgtctgctgtgctcttgcctgttttgcagcttcaaccatgtttttcaatgctgcaaccgtttcttcctgctgtcttgttttcaatccgcagtctggatttacccagaagcggtcagtcggacagacggcaagcgcatcaacgataatattgtacatttcttcagttgacggcacacgagggctgtgaatgtcatatacaccaaggccaagccctttcaaatacgggtggttttttaagtaatctaaaaatcctccgtggcttctgctatgttcgattgtaatcacatcggcatcaagatcattgattgtatcaacgatatcttcgaagttgctgtagcacatatgtgtatgaatttgtgtctcgtttttcacggaagaagtggttaatctgaaagcttctgccgcccaagtcaaatactcatcccaatcgcgggttttcaatggaaggccttcacgcaacgctggttcatcgacttgaatgatttgaatgcctgcgtcttcaagcgctttaacttctttgcgaagggcaagcccgatttggaaggcgatttctttcctcgagatgtcgtttcgagggaaagaccagtttaagattgtaaccgggcccgtcagcattccttttacatgcttggaagtcaatgactgtgcgtagactgtgtctttcactgtcatcggttcaataaattcaacatctccgtaaatgactggcgggcggacacagcgtgagccgtatgattgaacccaggcatatttagtgaaggcgaaaccggccagcttttcaccgaagtattcgaccatgtctgtccgttcaaattcgccgtgaacaaggacatcaagctccaattcttcctgaatatcaatccatctttttgtttccgcattgataaagttttgatactgttcatcggaccactcagctttccgccatttttggcgtgcgctccgcacttcagcagactgcgggaagctgccgatcgttgtcgtcggcaaaagcggaaggccgagagattcattttgcagggctaaacgttcttcaaacggaatcgggcgcttgaagtctttatcagttaattgctcaagctctttcttttgttcagaattggcgcctgttgcaaactgtttaagcgcctggatatcagccttagcctgctgaatctcttcgctgatcgccgcttttcctgatactaagccttctttcaaagctgtcagctcggccagcttttcttttgcgtaggataatccgttcaataggtctttttccaaatgctcatcagggtgtttcgctaccggaacatgcagcaggctgctggaaggctgaatccacagttcatcaacttttgcaatgctgagaatatcaagaacggcatcgagacgctcttcaaggtccgctttccaaatgttgcgtccgtcgataacaccggctgccagcactttgtctgtcggaaagccatgtgttttaagctgttccaggtttctgcctttgtcgtgaacgaaatcaaggccaataccctgaaccgggtaagagatcagctcttcataagcatcaacagaatcaaaatacgtctgcaaaagcacattcaaggatgaaagctcacttgtaatgctttcaaataattcttttgcaccgcggacatcttcactagaggcggtaacgagcgccggctcatcgatttgaacccattttacgccttcttcttcaagctctttcaaaagctgtacatataatggcacaaggcgtttttggatcgcttttgcttcagacggttcatagcctttagcaagcgtaacgaacgtataagggccgacaatcacaggctttgtttccacaccgtattcctgtttgatccggcgataatcttcgagttgtttgtttcttgtcagacggaactcaatgctctcgtcatattccggaacgatgtaatggtaatttgtattaaaccattttgtcatttcactagatacggcgtctttgattccgcgggcgatagcgaagtatgtatcggtagcgtcagtcaaatgtctaaaacgtttcggaatccagttgaagctgactgctgtgtcgagtacatggtcatactgtgtgaaatcagaaacaggcacaacatcaatctgctggtcaatttgtgtttttactgcggataaaaatagttcgtcgatttgcttcaaaaacgtatctttatcagtactgcttttccaatacgcttcaagtgcttttttccattcccggttcagtccgattctcggaaatcctaaattcgatgttttgatggttgtcattgtttctcctcctttatatgtaaaacactctctttaacccgcggatacaggctgctaagaggttttctcacaacaaaaagcctctttcccatgagagaaagaggcttttctacgtaaaacactgcctctctcatctctcagacacaatctgatggaattagcaccgtgccttatgagacatcagtctcggcgcgaaaagcagtgcgccccatttcacaatggtattacggtcggttgctgttggggtcaaaaggccaatccctcgcccaactctcgataagagaaaatgttattaattttttgaaaagttgaatcatttgttggtaatcttaacagtaattcaaattcattgtcaacatagaatttgaaatttttatttatatgatgtggtgtatattatataagaaaaataatcttatagggtcaacaaatgtgattgctctgctttttctgcgagctcatcaggagctgttaaatacaggaatccattgcctgccagcgtttttgcaatttcaagaggaagtgtcctgcggattagctgtgcgaaaacttcagattcagaaagctttctttgaaatgattcttcttcatagcttttgattaaagcaagcgctccgctgacatgaggggcagccattgaagtgccggtcagcttaccgtacttcttgttgggaagggtggataagatattttctcctggtgccacaaggtcaatctctttattcgcgttagaaaattctgataattctcgcgctactgaaacagatccaactgcaatgacttcgttataagctgcggggtaggaaagctcttctgtgcgttcgtcgccgtcaccctcatttcccgctgcacaaacgacaagcactccgtttttgactgcgtttttcactgcttcttccagctctggcacatcgcttggccctccaagggacattgagatgatgtcgactttctgttccaccgcgtagttgatgccgttgattatccattcgtattgtccgctgccgttctcgccgccaagaaccttcacaatcaataggcttgcctcaggcgcgactccggcaatgcctccgtttgaatcattagctgcaatcgttccggcgacgtgtgtgccgtgtccgttgtagtcggaaatcgcatcttccttgccgccgtcgtcatccgtgaagttctttccgccgatgatttgattttttaaatcagggtggcttgtgtcgcagcccgtgtctaatacagcaactttaatatttttgccttttaccccttttgcccacatttctggcgccttaatcactttaatgccctcaggaagctcgtttacatccatgatcttctcattcgtcacatacgggatcaagcggatttcaccattcataaaaaagccctccttttttatgctttcaagtggattcaagggtgttgcctcatattatatgaaaaaagcaagcgctcggacagagccatttgaagcattttgaaaaaataggatacacaccaaagaattagtaatcttcaaaatattggatggcttcggcgtgtatgactgggattcaactgtaagtcaagttataatagtgttggggaaaggagcagtgtcatgaaactgaatgaaaaattatatgcatttttttcagagcatgtggaacaaatggccgaggaatggattgaaacgatggaggaaagtgatccgaattcgctttacgccctacataatgcaacagtaacggaagaattgaaagagcaggacagagaattttaccggcatctgaattacatgtatgttttaccggaaaaacaatttctcgaagagtttcaagagtgggtcattgagctgaccaacgatcaaaaacatcttgacacaccggttcagtatgtcattcgggagtttatgagaaacaggagattatatacgaagtattttgagaagttcgcagaagaaaatgagtcagcgtttgaaccgggagagaagcaaaaatgggcagatttgattgtaaaagtatttgatttcaccatttatacattcgttgatcacgctgaaatgaataccaagcagcaattaaacgcccaaagagaaatgatattggaattaagctcacctgtcattaccctgagcaaatcaacagctctgctgccgcttgtcggtgacattgataccgaacgggcgaagtttattctggaaaacacgcttcaagcttgtgcgaaaagacgtgtggagcatctgttaatcgatctgtcaggtgttgttgtggtggatacgatggtggcgcaccagatctttaaattgattgaggcgcttaatctgatcggtgtccggtcaaccctgtcaggaatcaggcctgaaattgcgcaaactgctgtacagctggggattgacttttcgaatattaccattaaaaccaaccttgcccaagcattaaactatcatcaataaaaaaatccgctatctgtgatagcggattttttatgatgcgaaacataaagatacgagaaaggatcccgcaaataataagaggacgaggcaaaagaacacccagtcgtgccggttcacgctcaatgtcctgtaatatgtccggtttctgcttccagtaaaacctttcgattccatcgcaagcgctgtccgttccgcttttctgatggcgcttgccaatagcggtatggtatatcgttttaacgcactgattttcttaatgatgccgctctccgccgctcctcctctgattttatgagcctgctgaatcagctggatctcatcctttaacagcggaagaaagcgaaagcctgcaatgacaccgtacgcgagctttggtgagagcctgcactgctggacaaggctcagcataaataaaatcggatcggttgtaaaaacaaacatcatcgataaggcggaaaagcataaaatacgaaacccaagggagatgccgacagacacattatcgctgttaattgagatagggcctgcttgaaacaaaaaattatccggtgttgtcggcacctttccaaaaactgcggctgtccacacgcacccgaatgctaaaatcaaaaacggaatcgtaaacaacaaccattttttcaatgggattccggccgccagtagaacgcccgcaacgatgatgatataaaaacatgccggagtgtaagggttgtaaataaacgacagcatgacgacacaacaaaaaaccgccgccgctttcacagtcggattaatgagatgtaacggctgcttcatcacgcacctcctcttgatatgccatccattcatatagaagaggaagggtgagctttgctttttggacaagccctgtttcttgagaaaacaactgcgctggagatccgtcaaaggccaggcccgtatcgtgaagcacaagcacgctgtcagcatacgaagagactagctccatatcgtgtgtaatcataaggacagcggttccctctgccttgatacgctgaatcatttccatacattcagccgccgtgcgggcatcctggccaaaggttggttcgtctaataataaaacctttacgtcatgcatgagcatagtagctacgctcagtcgccgtttttgtccttggctgatcgcaaacggatgatgatcagccaaatgcgcaagaccaaaacgctgcagcaggtgttgcgcttttttctcagtttcagcatttgctttctggccgaacagaagctcatcatacaccgtatcggtgacgaattgatgctcagggttttgaaaaacaaatcccatccgtttacgcaattctttttctttatatttctgcagcggctggtcataaagaaggattttgccgctttgcggtttcatgagacgggccagaactgataagagcgtcgattttccagtgccgttcggaccgacaagcgccgttaaagagcctccgcgcaacgaaaagctgatgtctttgaaaatcgtctgctgtcctctcgcgaacgaaaggctgctgacttcaagcacactctccccagaaggagcttccttctttttggcatgcccggcaggaataggctctttgaatagcatttcttttgataaagtaaacggcatactcagcttttcctgcagatgacagacctttggaatggcgatgcccaatttctttagtgtctccgcttcatgctgaaatagatttttcgtcaggccatccagcgcctttttgcctgatttgtcgagtacgatcgttctctcaatccaaggcgcccattcatcaagctggtgctcaatgacgaggaggctgaaacctttttcccgctgaagatccttcatcagatgaacgaactcccgcgctgagaaagggtctaaaagagaggtcggctcatctaaaataataagctcaggctccatcgccaaaatacaggcgagagccactttctgcttttgtcctcctgaaagggttgagatcgttttttcttttaaatgggtaatgcgtaatttttctaatacggcgttgattttctctgtcattgcttcttttggaatttgcagattttccagcccgaacgcaatttcatcctctaccgtcagcatgcagaactgctgatcaggatcctgaaaaacgaccccggcatgctgagcaatcgtttcggaggtttcagcatctgtgaccggcttttgaaatagaaagacatgtccggactgaatgccgtcgcaagcctccggatatagaccgtttaaacaaagggcgagcgagcttttaccgcatccgctcggtcctaataataaaacacattctcctttttgaagctcaaacgaaatgtcttgaaaaaccggtttctcgtcttcttcataagagaagctgagctgctcaaccgtcagaagctcatcaaaggcttgcatgttctgacgcccgcttccgtttctttttcagttcctttccgagtgccattccgtttaacacacctgtataagcgagagaatcgctgacagcttttccgagaagccccgccaaaagcgcgccggaaatgaggcggatcacaagcataatgagcagataacctggtgaataggctgcatagccagaaacaaagagatcatagataaagctggctactgaagaccccataccggccagcataaggacagggagagagtatgctttccagcgtgttgcaagaaatacagcctcagccccgagcccttgaacaatgccaatgacgatgaccatcgggccagacggatttcccagcaggcactcaacgagagcggcaatgatttcagaaacgagcgccgcacccggtttttgaatcatgtacgcggcgatcacagaaacgataaaccaaatgccgtaaatcggttcataggcgattggcccaaacatacctgcaagcacgtttccgaaatgtgtaaataataaataaacaacggcaaatacgatactgataacggacatgatgacaatttcttttactttccagcttttcattttatccctgctttctgttttttcttgatggactgttagccgaaagattcacagtcatggtgatgtggtttgtttgctgctcagccatgcggaaaacggcttccaatgtgctgaatacgtcatgcgcatccccgtcaagctcgctcgcgtaatggacaccctgtacgaaagtgccttgggcttttgcaatgtcgacagccttcataatcaatcccatataatccggctcgttcattggataaagggcaaattggcacggcgcttccgccttcaagcctcggacagcatcttcattgacacgcttatcacctttggaaagatatgtatccccctgtgtgtcacccgggcatccaatggaaaacgtgccgttcatgacgatgtgttgttcgctgtttgctgcatgaaggtaaatggcttttgcagcatcgaatacatgatcaatcgatccgcgtaacaccgtgctgatatggtcggttttcgtccataccttggatgtatctgtttttttcagcgcagacttgatcacactgataaaatcatccgtcatcggatataaagagaagcgaaaaccggcgattctgcttgtaccgcaaatatgctccatttctccgacctcctgtttttttggtaaaataaaaaactgcatatcctaagggaatatgcagtcatagatcgattaagcgcacaaaaaaatacaccattcggtcaacctgcacttccccacgctggtattatccagatcgggtcataagggatcaaagcgcgtttcttccgcgctttatctcagccaaaacagcacccctagtgctttccgtatacaattttttattttgacatcataatagatgataagaatcattttgtaaacaacgaaatcatttttttcatatagggacgggagaggatgatcaaatttggaaaaaggacacatattaattgtggaagatgaagaaaaaatcgccagggttcttcagcttgaattggaatatgaaggatacagcgtcaccatcaaacacaatggcacagaaggtctggatgcggcagcgaaaggcgggcattccttggtgcttcttgatgtcatgcttccggggcttagcggactggaagtgctgcgccgcttgagaaaaacggatccgcagacaccggtcatattattaacggcgcgagacagtattcctgataaggtaacaggtctggacatcggtgcgaatgactatgtcaccaagccgtttgaaatcgaggaattgcttgcgagaatcagggcggcgctgcggcaaaatggaacaaaaacggaagatatcggcacctttcttacatatgacgatttgcgggtgaacgaaaaaacccgtgaagtgagacgcggagacaaagaggtggaattaacgccgcgggaatttgatctactcgtctatatgctaaagcatccgcagcaagtgctgacacgggagcaaattctaagctcggtatggggatttgattatatcggtgatacaaatgtcgtggacgtctacataagatacatcagaaaaaaactggactatccttacgaaaaacagctgatccatacgattcgcggggtcggctatgccattaaggggtaaacgatgaagctgaagaccaagattcatctatacacatcaatatcactgttgattttattaattttggtgcataccgcagtctatctcattttttcgtctgcgctgacatcaaaggatgcatcccggcttgctgatgagacggataacattgccgaagcgctgcgtgccgctgaaacagaaggagtggctttgcaggatatgctgcaggcctatcttccggcaaatggcatggtgcgtgtagtgaatggtgatcaaaaagccgttatgacgatcacaaaagaaaaagcctataaagattttcctctctcttttcatagcggagaaacggcagatgtgaggaaacatgacggcaagctgtttgccgaggctgctgttccggtaatttggaccgatggacaagtggtttctcttcagctggttgaaaggcttgagaacacagaagagagtctgtttctgctgaaaatcatcttaatcgctgcaagtgctgctgtctgcattgcttctttttttgcaggcagcttgctagcccgccgaatcatcaatccgatcagacgattaatgatcacaatgaaagacatacagcgagacaaaaaatttaaaacgatttctttagaaggacagtccaacgatgaattgtatcaaatggggctgacatttaatgaaatggcaatgatgctgaaggagcactatgataaacagcagcaatttgttcaagatgcttcacacgaattgaaaacgccgctcaccattatagaaagctacagcagcctgatgaagcggtggggggcaaaaaagccggaggtgcttgaggagtcgatagaagccattcactcagaagcggtgcatatgaaaaaactgaccaatcagcttttggcgctggccaaaagtcatcaagagcttgatcttgatctgaaaacaatcgatctgattgaagcggcgcgcgcggttatgcaaacgctccagtccgtttatcagcgtgacatatttcttgaaacagataaagagagcctgcttgtaaaggctgatgaagaacgcatcaagcagctgttgaccattttgcttgataatgcaataaagtatagtgaaaagcctattgagatgtcagctggaacgaggaatggacggccatttttatcagtgagggatgaaggcatcggaatacctgaggagcatatcccgcatttgttcgaacggttctaccgggcagatgaagcacgaaacagaaaaacaggcggaacgggtttaggcctttccattgccaagcaaatcgccgatgagcatggcattgagctgtctgtcaaaagcaagccgggacaaggaacagctgtcaccatgcaattcagcgaacagaatgggggaggccgatgactaaaacaataaaaacagtatcttttgccgcagcagccattttagttgtcatcatctgtacgtttctcatcattcggcaaacccatgagaacgtattgtcaaaggagactgtcgtaaaaaaagtcgaatcctcttatgaaggcaaggtcacgaaagcaacacaatcaaaggataaaaaaacatatgatataacgcttgaaaatcaaaagggaacttactttgtaaaagcagacgcaatatcggctgacattctttcaatgaatagagtaaaagcagtgaatccatctgccatgacagaaaaagaagccgagcatctcgcgcttgagcgggtgccgggaaccgtcaaaaaacaaacacggcaaagtcgagttgccacttataccatacaaaaagaagatgggaaaacatacgaagtgaaggtagacatgcaggcaaaaacagtcttgtctgccgatcaaatcagcagcaaagatcaacaaaaaacgccgattacgaaaaaagaagccaaaacaattgctgagcgagaaacgggaggaacagcggatgacgcagatctcgaagaaagtgagggcactctcatctttgaagtggacgttgatcttcctgatagcaaggaagcgacagtgaaaatcaatgcctacacaggaaaggtagctaacattgtgtatgaagactgacggtttctcatcaaattctcatcttgctctcgttttcctttcatgttgagtgtgtaaactgtactcatacaaaacaaaggaggactcacaaatgctcaagaaaaaatggatggtcggtcttttagcagggtgcctagcggccggaggattcagctacaacgcgtttgccaaagaaaacaatgaaaacagacaggcttcttctaagacggatgcactcactgaacaagaagcagaagcaattgctaaaacagttgttgacggcacagtagaagacattgacagagacctttacaacggcaaagaagtctatgaagtggagattgaaaaagaaggtgaagactacgacgtttatgtagatattcatacaaaacaagcgcttaatgacccgttaaaggagaaagcagaacaagtcgccataaccaaagaagaagctgaagaaattgctttaaagcaaacaggtggaaccgtaacagaaagtaagcttgacgaagatgacggtgcttacatctatgaaatggaaatccaaacgaagcaaggaactgagacagaatttgaaatttccgcaaaagatggacgcattatcaaacaggagatagatgactaatcaaaacccccgctgcagcggggtttttcatgataagaaaccttcttttggacaatctaagtagaaaaggaggcgaaacgcatggaaaagaaagaggagcaatacatcaatcaggctgaatatgtccctcatccgacgaaggaaggagagtacgccttatttcttcatgaaacgtatcatttgctttctgaagatgacgagacacaaacaacagaataagggctttggcccttgttttgttccgtaattgtgatgtaagcgcatttattacttttttgagttgacacagcttgtttttttctgtaatctcagtgtgtcaattcaattaggaacttcgttaggtgaggctcctgtatggagatacgctgctgcccaaaaatgtccaaagacgccaatgggtcaacagaaatcatcgacataaggtgatttttaatgcagctggatgcttgtcctatgccatacagtgctaaagctctacgattgaaggcgcccgcacgctttttttgccgtgcttctttcaccttcaatcccgaaggctttttttatgcctttaaaacgaaaccaatcaaaggaggtgcggagtatggattctccccattcgagtcaatctgaagaagtacccatatactatgacagcaagacaattgattacacgatgaggagacgaactgccgcaccttctggcgaggccggcacgtctccgtagaggaggtacgagtcccgatggttcaaaacatgacctatgacgaactcattttacgcatcattattttactgcgagacgggaaaatcagggatttcagaagtgttattgatgagcttcagccctatgacatggcatttatttttaaagaaatgccggaaaaacaccgcgcccgctatttatcttatttaactgtagacgatatcactgatatgatcggggagctggaacgcgaatttcagcttgtcgtcttaaataaagtcggaaaaacaaaagcaacactggcgatgaataaaatggacaacgatgacctcgctcaattgcttgaagaaatggacgaagaactgaaggaacagcttttgtccagcatggaagcgtcagaatcaaaagctgtacagctcttgatgaattacccggctgattcagcgggacgcatgatgacaaaccggtatgtgtggattcctcagcattacacggtaaaagacgcggtcgtcaaactgaaaagcttcgctgaaatagctgaatcgatcaactacttatatgttattaatgaaagcaaacagctggttggggttctttcctaccgcgatttgattctgggtgaacctgaagaaaaggtgcaggatttaatgtttacccgcgtcatatcagcagatgctcttcaggaccaggaagaagttgcccgcctgattgaacgttacgattttttggcaataccggttgtagaagaaaacaacgtgcttgtcggcattgtgacggtcgatgatattatcgacgtcgttattcgggaagctgatgaggattacgaaaaatttgccgcttccggtaaagacatcacctttgacacaaaagcttacgtggcggcataccggcgcctgccatggctgattttactcttgtttatcggactgatttcaggaagcattatcagctattttgaagacgcgctgaagcaggttgtcgcgcttgcgtttttcatgccgatggtatcagggatgacaggaaatacgggaacacaatctctcgcggttgtcatcagaggtttgtctaaagaagaaatgaacaaaaaaacgattgtgcgcctgatcttccgggagttcagaacaagcatttttatcggagcggtttgttctgtgctgattgcgattgtctccatcatatggcaggggaatgcgcttttgggatttgttgtcgcctcttcactgttcttaaccttaatcatcggcacgatgtcaggaacgattatccctattattttacacaaactgaaagtagacccggcaattgcttctggaccgctgattacaacgttaaacgatattttatctttattaatctactttggcattgccactgcattcattcactctttataaacgtaaaaagtccgtctcaactgcgagccggacttttattatttaacggtttttgtaccgaaagtgagcattaagctgcccctccagcatttttttccgcacttgcggatcgttttttaacatctgttcttttttgcgcatatcctttaaaatctctgccgtctgtacgccgtcttcacgtttattggcgatatccatcagccgctctacatcagcaaaggagtattttcttgtcccccttgaagaacgctgcgggtaaatgagctttcgttcctcataatacctgatctgtcttacggacaatcctgtcaattcactcacaattccgattgaaatcacttttttgtctttataagaatgatcttctgtggtcatttttccacccctggatgtcttttgataatagtatataaaaaacaaagagaaaaaacctgacgcttgtcatattttctaacatcaaatagaagatttttgaaaaaatacggaagaaaaattaacaagaataatgcgtaacacccaagcgcgttttatcctttatgtaacgaatcaaacgaggaggaaggataatcatggaggaagaaaaagcggtctcactggcaaaagaaattatagagttggatatcaagcgtgatgaaatgctggagacgtttatgcagcttgccggagaacaggcttttcaattattaagatcggttcaaaacggacaataccgaaaatcttcgtaaacataaattctttacattagattcataccacgttcatttaaaaagagtatcttttgtataggatacctcaaaatgaaggaggacgctatgagtaatttattgaaatccgctttagaaaaagaacgacgccattattctgaaaaactctatcagattggggtttataataaagaggtcatgaacaaaatgacgatttctgagcttcggaaagaatacgcttatttctttcgaagcattacaaatcataaaaattatccttatacaagataatgtataaggatttttttgcttttagaaggaatttctcgaattatagcgaatacgtatagtaagggactgaactcttattatatgtaagggttttcattatttttttataaaaatcctatatacgaggtagatatgatgagattatcgtttaacgaagaagaagttgagcgtgcgatgaatttgtacagagtttttgcaagggctttcaaaagtgtgtccgaacatagtatccgtgatagcaaagagcacggttttaatcccactgaatttgctgtactggagctcctgtacacaagaggcccgcaaaaattacagcaaattgggtcgagacttctgcttgtaagcggaaacgtcacatatgttattgacaaactagaaagaaacgggtttttagtaagggagcaggacccaaaagataaacgctctgtttacgcacatttaactgacaagggaaatgagtatttggataaaatttatccgattcatgcactgcgtattgcgagagcgttttcaggtctttcgcctgatgaacaggaccagctgatcgtcctgctcaagaaagcaggcatacacagccagcatttgctgtttcgttaactattctacactctctatttcaggagagtgtttttttgtttccatatgactctttttaaaacatcttcaatcttcctatcagacatttcgccaaggtatccattgacgtgttttttatactccttcatctgttcgttcgattgaaaaaataccgcgatatactcttctgctttctgcatgtcccagtttctcatatctgttacgagcttcctttcatgtagaaggtttaaattcatttcctcctgtcccggcagtgcatgataaataaataccggaagccgttactgtaagcattcactgatggtcacgcctccgggtttagtcatgatgcctgtcgcctgttcgtacaaacggttcatctctgctttgctgtgaaggtaaggaatcgcctcaatcaaggggtggtgtaaacttttgacataggagtagagcttttcgtttctgccgcataatattttgtataagatctttccgcctggcgacagttcctgcacccattttaaaatcccaccgacccccatactgccccctgtgatgatgatggtatatggcgggtggtgctgcaaggtatctgctgattccatttcaaaatttcggtgaactggaatgccggtcaagtatatgttgttctgatcgatcccctctgatattagctgcttctttacttccgtgctcggaacaaaatggtaatcaatgttcttccgtccccataattgattcacgaaaaaatcagtgtatacattcactaccgtcagattcggatattcaggctttagtcggttcagcagataagaaggcagcgcatgtgtgcagaaggcgatatcaggctgtttttcttggaggatgtgcctcatttgctgtgtgaacagccattcgtacatgaaatagcgtttgtcatgctgaaattctccgcaggcgaggagcctgtaaatgccgctgtacgttttcgggaaatattgaatccattttaaataagccacggaggacaatttttctaaacggctatacgcatgtgaaaagatatcaatcttttcagctgccagcccttgagactctaattcagcctgcaatgcatcagccacatgatgatggccggtggaaatgcttaaaaaaggaaaaatgagaatgtttttcatgacagtcctcctaaaaaaatatggcaactatattttgaggagaacgttcacaaaatataagggtgtttttgatcataaggaaggtgaaaagatgaaaacttgtttcctttccatatggagagtggttgacccgatttatttctttttttcaaggctaagcttgattgacaacgatcaaaaaagcgtttttcgagtcaggctgacgaagtataaaggacatcatgtcgtactgagcgatggaacgcatattagaaaaaatgatgtgctcgttaaaattcatctgcacaatattaagctgataagagaactgcaaagcattgagagcgcggtcagaaaaggaatcattatttatcagaaagtatatcaatcgatgccgcttcttcttgactatatcaacaatcataaaaaaagcgagaaaattaaaggaatcattgggattacaatgcttgacaaaggtgtggaaaggctcggctttgatgtgatcaccccggtgaaccctttttacagatgctttaaaaaagtgtcccatgtgccgattttatatttgacttcaaagcctgtgagcttgcggcatttaccgaattcatcctatttgtttatctcaaaagaaaagctgcagaaaacctatcaaaaaaaagactgatgcctcggtcagcacagtcttttttgattaaatctgatgaaatgttacttcagggcggcttccgacacggatatttacgccggtttgtcccaagccctcgctgatataaaatggtttatcgtaatgataatgaaggcctttaatcatgttcattcgcacgagcttgcccattttcaccaaatgatacggttttggccagtgaatttgcccgccgtgaaaatgccctgacagcaggtaatcataatgaacatctttcatatccagaataatatttgggtcatgtgttaagacaagatgatagccattttccagactttgataagagccggtgatattactccgattcgtactgtaatcatcaatgccgataatattgactggccctgcagccgtctcgattcgaacatgttcattttgcagcgtaatacagccgttttcctctaaaactcgctttaatctccgaaagtcctcttctttcaatacataatcgtggttaccgaacaccgcgtacattccatatgcaggcttcagcttttgcaaggcgttcaagtaacctgccagcttcggaatattacgtttccgatcaagaaaatccccggtaagagcaatgatgtccacaggctgatcttttgttaaatgatacagctcctcaggtgagacagaaatgttttccaagtgaagatctgataaatgaaggatatttaatttttttctggctggaaggccgtctttttggtcgattgaaatggtgttgactttcacatcttttgtattgcggttcgctttatatagaaatggcacaaatacgagtatggccaatgaaagtaagattgtaaacaaaatatatcccctcccttctatcagtatagtaagtgatcaagccctatggatagcgggaattaatgggtagagacaggctgaaaaacggattgtcatatgatgaatgatttggaagggaaaagggataataaattttgacacatgaggcagaacatgccgatggagtcagaataacaaatggatgtgtaagcaatgttacgattgatgagacaacaaaaaaaagaaacatattatctctggatcgcattatttcttcttttattgtatgtatccccgctttttattttaaaggaagatgcccatatccgggtccacgataatttagattccaacatcgcttggtacaaggttctggccgatagcggagaaatcgtcggcaaggttgacgctgccattccccaaatcattaacgggctgccccgggatgcctttggcaccgagtggagcggaattgtttggctccatgctttcttttcttccatgaccgcctatgcaataagccagacggttacaagagttgtcgctttttttggaatgtatgtgctgctgaagaaacatataatcccggaaccaaaagcggctttcatccgaattggcgtatcgcttgcatttgccttaacaccgttctggccttcgggaatgctgagtacgcttgggtaccctttggcactgtgggcttttttaaatatccgaaaaggggatatctcatggagagagtggctgacgctgggcttgcttcctctatactcaagctttgttctaggcttcttctttttcctgacagggatggcgtgtttttggctgtatgatgccattacaaatagaagatggaatttgatgttcttaggcagtattgcatttatgacgagtatttatcttttcgttgaatatcggcttgtctattcgatgctgtttgaacacgcaccgatgcatcgtatcgaatttatctcatccaggcatgacgtttggcagtctcttcggctatccgtaaaaaactttgtctatggccataatcatgtgatgaccgttcataccgttgtcatcctcccgatcctgctggtcgtatttgctgctctgctgttcaaacgaaatcggacaaagccagaaaatgtttatctgtttttatgtgtgcttaattacgggttgtcattatggtatgcgttttggttcaacaaaatttgggctgttccaaagcagaaatttgcttttttagcagaatttaattttgcccgttttcattttcttcggccgcttgttatatacgtgagctttgcgcttgctttatatctcatttggcggatggggaaaggatggaaatggcttgtgtacgccgcagtcgctgcacagctgatggtgttggcgccttttaatgaagaatatacgtatggcgttcattacaacgcgccgacattcaaggagttttatgcatcggaacaattcaaagagattaaggaatatatcggacgtccgcaagattcgtacagggtggcgagcatcggactgcatccgtctatcgcccaatataacgggttttatacgttagatacgtataacaatctgtatccgctctcatataaatatgaatttaggaaaatcatcgaaaaagagctggaaaaaaattctcggctgaaacaatactttgatgaatggggcagccgctgctacctttttgtcgatgaactcggtaaacgatatgatttcaaaaagaactcgaagaaaacgatcaacaaccttcaattaaatacagatgtatttaaaaaaatgggcggacggtacattttttcttcagttccgatcatgaatgctgaacaaaaccatctcgcgctcgtaaagacgtttgaccataaagattccgcctggcgcatttatttatatgaaacaagataaggaggatatcgattgaaacagtcacagccagtattaaccatcgtcgtcccgtgtttcaatgaagaggaagtgtttcaagaaacaagccgtcagctgacagaggttgtagatgatttaattgaagaaaaattaattgctgaagacagtaaaattctgtttgtcgatgatggcagcaaagaccgcacttgggctttgattgctatggagagcataagaaacaagaaggttaccggcttaaaattagcctgcaatgtcggccaccaaaaagcgcttttagccggactgcataaagcgaagaataggtcagactgcgtcatttcgatcgatgctgatcttcaggacgacatctctgtgatccgggattttatgctgaaatatcatgagggctgcgagatcgtttacggtgtacgccggagcagaaaaaccgatacctttttcaagcgcacgaccgcgttagggttttatcgtctcatgaataagcttgggattaaattaatttataatcatgctgattttcgtttaatgaataaaaggtccctcgaagagcttgagcgttatccggaagcgaatctgtttttaagaggtattgtccctatgatcggctttaaatcggccgaagttttgtatgaccgcaaggaacgctttgctggcaaaacgaaatatccgctgaaaaagatgctatccttcgcttttaacgggattacttcattcagtgtcgcaccaattcgattctttacgcttttagggtttgttttgtttttcctcagcgctgtggcagggattggcgcgtttattcaaaagctgctcggccatacgaatgcaggctgggcgtctctcatcatatccatttggtttttgggcgggttgcaattgatgggaattggcatcatcggagagtatattggaacgattttttctgaagtgaaaagacggccgaaatacgcgattgatattgatttgtataatgagcagctgagcccgctccagcgccaggaaaaagagcggttagaaaaaaagtacagttaaacggaaagagctgacttcattagtcagctctttttctttaactgatgcaatatggcgctaagcggttcgtcttgcgggttgcggtaaaaatcaaaaaatgggcagccctgcttcttaattcgatcgatgaccgtatcaattgtaaacagagcgggtgttaaagatgattgcacctcatgccagtagagcggggctgcgacagtcccaagctcatttcctctcgtcgaatagggacagataatcgtttttccttctgcgtgctgcaaataatcaagatacaatttgccgtgtctgtttttaatcaagcgttcagtggtaaagagctcgggaaatgcattggtgcagtactctgcgatcagctgtgtaaattggcgtgtttcttcatacgtaaatgcctcgggagacaagggaatataaagctggatgcctttgttgccggacagcttcgggtacgatgtgatgccaaaggaatccaacagccgcttcagttcatttgcggcctgcacggccataagaaagtcatctcgcgaaggagggtctaaatcaatgacaatctcagccggacgcctgcttttaatggtttgaaaaggaacgtgaaactccaaagcaagctggttgcaaagccatagcaatgtagacatatcctcacagacaatatgttcatggcttccatcatagaaagattgaacaaaatccggcgcatagtccggcttgtttttttggaaaaatgattcgctcctagatccatgcggatagcggatgacggtgacagcccggtttttcagaaatgggagcagatagtcactgacttcaatcatatactgaataaaatcttcttttgtttttttattcttttcaaatatgattttatctaggcttgtgaactggagctttgggtgaaccggtttggagtgtcgtatgacttgcgcatacgtgcattcggtccagtccatttggaattcgaaaccgataaacgatacctctcttaatgtgccttggagaattgttaagtattgaacagatgcacaaatcgaaggttcaagactaaattcgcctgagggtgtttgatgtccgtgctgttccataatctcgcgtatagcgcttttttcctcatcgcgcattccgtgcgagacagaggcaatcggtgtcattattccgttttttaacacagataccgtcagaaacccgttgttagggttgaaccctgttatgcaaacataagcttgtttaaagtttttatatttgagccaatcggacgaccgcttcttttcaagccatttgctgtttgttttcttcgctacaattccttctccgtcatattttattaccatctcccagagttgatcaaaatgatcataacagggaatggattgaatggtttcttttgcgtaaggatctggagatgcaggaagctttgctgcggatatgagttcacgcagcgattttttgcggtctaaatacgaaagaagcgttacatcttctccgcttcgctctaacaaatcaaaggcgagaaagcagcacggccgcgcgtgtgccgattcctgaatcttgtctggccttttcaaacgcccccgcacttgaaggtgttcaaaatctgcacgacagggattcaccaaacatacgatttcaccgtcaagtgtcagcggaagctctttttctaggtgctgaaaggcagttttggcgaattgtgtgatttcagggaaggtgctgctgagctccacaccatttctgctggttaaggtcacacctgaagaatagatgcggagaatacagcggtacccatcatattttacttcgtaacgccattctgctccgattggcggtgacgaagttaagaccggctgcatggtaaacgccatgcgctatgatgtgccggaggctttttttctagttgttttttgttttttatctccggctcctttcggttcagcggcttgtgcaggtgcggcagccggtgtctcccggttcggccttctggttctgtcgatgctggcttgcagagcgcttaccaggtcaatgacatcttcacgaggtggcgctttatcaggagtcacagccgtttctttattttctagcttgtcgttgactctttgcagcagcgcctgtcggtacgtgtcttcatatttctcaggctcaaactcagcagtcagttcatctattaatgtgatagcagtttgcagttccttatcgtttacattcgattgatcaggtacacctgggacatgagcggcgcttctgacctcatcgggataatggatagactccatgacgatacaattttcataaacacggagaatcgccagctgctgctttgacctgattgtcatattggcgataccgatctttccggttgagcgcagcgcctcacgcagcagggtataggccttcgtcccattatccccggggccgacaaagtaggagcggttaaaataaatcggatcaatttcctgaagctgaacaaagtcaacaatctcaactgctttctcctcatgctcctgttttaagctttttaaatcttcgtccgtcagcactacatattttccttttacatattcatatcccttcacaatttcatcaggactaagagttttttcgcaatttgtgcaaactttctcgtatttgattggtgcgtgatcctctttatggaggctgcgcagtttaatatctttatcttctgtggccgcatatagcttgatggggatgtttactaatccgaagctgatcgatcccttccacattgtatgcatatcgataaaccccttttttctttagtgtgaagagaaggattacgattcatgtgtagtaacttatgggtgaaaaaaagccggcgctgttattgcgacggctgttcaataatgaattgttcgaattgttccggaggtattggcctgctgaaaaagaagccctgtaaatggtcgcagcctttttcaaaaagaagctgcttttgagctgcattttccacaccttcggcaatcacctgcaaagacagctgatgccccatggcaataatagctccggtaatttgctctgatttaggatgggtctgaatatcgtcaataaatgatttgtcaatcttcagcctgtgaatcgggaagtccttcaaatagctaagagagctgtgaccagtaccgaaatcgtcaatactgattctgattcctaattctgttagggatgataaaacctttttggagtgatcgagattgtccattgtcatgctttccgtcacctccacttcaagaagctgcggggaagctggtatttattaagcgtatccttgatgaggggaatcagatctttggattggaactgtctggcggaaatattaatggcgacagaaagatcatagcctttgtcatgccaaatccttgcctgcttgcatgcttcatctataatccactttccgatatcaataataagtcccgtttcttctgcaacaccaatgaattctccgggcggacgcagctgcccgtctggtgtcacaaggcgtatcagtgcttctgctcctgtcattttttgtttttttacactgaattgcggctgataatgcaacacaaatctatcgttttcgattgcttctctgagtaccatctcttggttaagcttgacggtttctttgttgccgattgaaaaagaatagtatctgtatttgcttttgtttcgttctttagccgcatacattgccatatcagcctttttcatcaattcaagtccatccgtcccgtcttttggagatatcgcaatcccgatactgacagatgtgacaaggatgtgatcttgaattttgaaaggttttttgaatttttggataatttttcttgccaaaacatctgcttcgcctgttcctgtattggcgtctgttaatataataataaattcatcaccgccaagacgggcgataaatccgttatcagggactacagatgacaggcgtttagctgcaaactgaagcagttgatcaccgacattatgccctaatgcatcgttaatcactttaaaccggtttaagtcgagaaagaatacaacggtgttataatgcaaggaatgctcgcgattcagcacctttgttagatgagagatggcatgccttctgttaggtaagtctgtaagtgaatcataatgagccattctatggatttctttttctgctttgtactgcttcgtcatgtctttgcaaatgacataaatgctgtctagttcctgattgacctcaacaggtataagcgtaatatttaagtggaactggcctttttcagtgataagatcgctatcgctgttcatcgcttgtttatcttttttaacttgctcaaaaaggcgcttaatcttctgtgatgtataattcctccagtcatgcatgctgaagccaaatttgctgatcatttcctcaccagcgtgattggaagatattatgtctccttctaatgataaaataaagattgcatcaatattgtggacaattaaagactgaaatcgttgttcgttatcctttatgcgttcgctctgtttaataaattttcgatctgcatgggaactgaataacaataacgtttggatacaaaaaataattaaagtaacaaaaattgaccaatgaaacgtttgcacctccatatggcttccgggcggagccatgttcttatggaaagttgccgcaagcatccctgtgtagtgcatgcccgaaatcccaatacccattacaattgaactgacgactttatagattataagatgctcagaatgttttttcacggccaagtcaaagaatatttttaacgagacgaaagaggctgcgatcgcaatgataattgaaactgtaaataaaatcggttcgtaaataatcattacccgggaaatggcagacattccgatatagtgcatagaagcaatagatgcgccaagcacaactgatccgataagcagtctgtaatatgtaagaatgtgccggctgacaaaatataatgacacaaatgatcccgaaacagatgcgccaatggctgccattaaaggcatgaattcatattccatcggcatttccatatggacggccatcatccctacaaaatgcattgaccaaataccgaatcccataataagtgagccgccgatcagccaaattttactttttaagcctgtgttgatggtgactttcctggaaagttcaagggaaatatacgaggcggtacaggcaattagaatagataaacatatgagcgtcgtattatatgtaacgtgtatttccaaatggagattcccccgtatcgtgtgttccagtcttgttgactctctttattatcggctgcttaaccgcagagtttcagccttcaaaacgatagaaatacgagggagatctatttttagttcaactgaccgtgaaaaatgtgttaaaatcatcttgacgttttccgaaaaaacaaaaatgtatgatacataaacatgagacaagggagttggtggctatcgaagagctggttatgtcatggatagaagcatttaaaagcttatcttattttggaatatttctagcgctcagcattgagtttattccagccgaagtcgtcttgccgcttgcgggctattgggtatctaaaggcgatatgacacttgccggcgttgttttggcaggatcgcttggaggagtggccggtccgcttacgctgtattggataggccggtacggaggaaggccgtttcttgaacgttttgggaagtatctctttattaaacctgaagcgcttgataagtcagataattttttcaaaaaacatgggggctttgtcgccttcagcggccgtttcttgcctggcatcaggacattgatttccataccgtgcggaattgcaaaaatgaatgtttgggtgttttcgctttatacattcattgctatgcttccgattacatttgtatatgtttatctcggtgtgaagctcggtgaaaattggaaggaagtcggctctattcttgatcaatatatgcttccgatcgggatagcgattttggcgctgttcctgctctacttactgatgaaaaagaggaagaaacgcacgcattccgaacaattatctgtatttttaaaaaataagcgttgacaaatcattgcgctgcgcatatcattgacgtataaaatcatatttcttgaaatcccaaaggggagtagcgtccggaatgtattccggaaacaaagtcgtcatttcatggattgtatccatcggctttgttggcatgcctgaattcatgtctagcaagacctttgccttatgtcggcaaaggtcttttttgcatggtccggccggcataagatcggatgaagagaaagaaaacaacttttttgggagggtatcgtttatggatgcagcattattattagagtatggttgggttcttctcgtcttgatcgggctggaagggattttagccgccgataacgcgctggttatggcggtaatggtaaaacatttgccggaggaaaaaagaaaaaaagcgttattttatggattggcaggggcttttgttctgcgatttggctctttattcgccatttcatttttggtcaacgtatggcaggttcaagcgattggcgcgatctatttgctgtatatctcagcaagccacttattgaaaagatatgtatttaagaaagaagatacacataaagagacgaagcaaagcggtttttggccgactgttttaaaagttgaactggcagatatcgcgtttgctgttgattccatcttagcagcagtagcgctggcggttacacttcctgggacatcactcccgaagatcggcggacttgacggaggacaatttctcgtcattttggccggcggtatcatcggactggtgatcatgcggtttgcggcttccatgtttgtgaagttattaaaggaacgtccaagcctagaaacagcagcctttgtgattgtcggctgggtcggagtgaagcttgctttatatacgcttgcccatcgcgacatagcggttgtttctgagcactttattcattctggaacatggaagctgatattctggggtgtcttagcagcaatcgcggtttgcggctggtttatgtcaggtgggaaaaaacagccggagggcgcacaaaacgagcaaaaaaacagcacccgtgaacgggcgtaatctgaaagactctgcttaaaagcagagtctttttgtgtttgaagcgttttcataagcgaaataaaataacatttttataacatctttgttacaaaaaacacgcataaaacccccttaattctttagaaaggcacgaaatcatgtataggacgtcagaatggtttgtcataattgagacattggaaatcaatatttctttttctcctttgcgaatccctatcaaattagctatcattaatgagtagttatagggaggaactgaggtgaaaccagtgcttagccttttgtttaaattgggaaaaaagaagcaaacacttgaaaaagctgttgagagtatacaaaaaggcaataaagatctgcaaaatgaattaatacagcaatataagccatttatcgcaaagacggtttcatccgtttgtaaacgatatatagatgaaaaagacgatgagttcagtattggactgatcgcgtttaatgaagctatagaaaaatattcacctgaaaaaggaaattctctgctcgcatttgctgagcttattataaaaagaaaagtcattgattacattagaaaagaagccagaagcgcacaaaatataaatattgatttacaggaaggagacgatcaggagtcatcacaaagcctgattgaagccgagctttccattgatgaataccgccgtcagattgaacaggagcagaggcgggaggaaatcctctattttcaaaagcagctcaaggattatggtttatcgtttaaagaactgcttgaaaattctccaaagcacacggatgcaaggcaaaacgccataaaggtggcaatgacgcttgttgaacatgaagaattggccgctatcctgtatacaaagaagcagcttccggtcaaacagcttgaacagcttgtctctgtaagccgaaaaacgattgagagaaacagaaaatatattattgcgatgtgtattatcattacgggtgattatatttatttaaaagattatcttaaaggggtgctgcactcatgagaagagggattatagtagagaaaaataaaaaattcgtcacgttgctgacccctgacggacaatttttaaaagccaaaaatgatcgacacagctatgaaatcggtgaagaaatcatgcttccgagtgaaacacgcatgggcagaagggccagcttttttgatttttttaaactgcgccctttcaaaatggggatttttacgatgactgctattatgctttttatttttatagttctccccgttttttctaataataaggcctatgcgtatatgacaatcgatatcaatccaagcgtcgaaatggcgttaaacagcgattatgaagtgattgaactgacacctctaaacgatgagggacagaaagtcgtgaatgatatagatgattgggagaagactgattttaaaaaggtgattgacgatattataaccgactgcagtgaacacgggtatgtaaagaagtcgaaagaaatattgatttccactgtttatgaaaacacagaagacaatacatataaaaaggctgtgaaaaaacagctgaatgatgtgactgaaaaatataaaacgacataccgcatggaatctctcgagtcagatatgcaaacgagggaaaaagcgaagaaagaaggcgtctcaacaggcagctacatcaaatcaaatgaaaagaatgacaataaagatttaaaagatgactccagcaaaccatccggggaagaggatcaaaagagtgatgaaaatgaggctgaaaacaccgatcaaactgacacccaggacagcaagcaaggagataatgaacagctgaatgatgcggattccggagaccagaaagaagataaagcggatgaccagattgatgatagtgacaaagataaaaaaataaaggaatcagatgaaaacacaaataccgaaaaagatggggaccatgagcaaaccccaatacaagatcctcaagataaaggaaatgaaaataacggcgctgacaagggccaaagccaatatcacagagactggaacaatggtgaacaaggcaagaaccgttcttcgtccagaagggataacgcttcagaccgacgtaatccaaacggctacagcagtgataataattcagctcaaaatgaagattcgccgagtgcccccggcgaataaagacctgaatttatttagttgtgccatttaattgtgattgtgcttgctgtaccagccgctttgtcatttctccgcctacagagccgttagcgcgtgcgactgtatcagaaccaaggttcacaccgaattcttgagccacttcgagtttaaattggtctagtgcctgctccacccctggaacaacgagtttatttctgctcgccatctttttcatctcctttttcgataaagaaattcttaacgcgtatttagtttgaaatatacggggtttatttatgctggcaattgttgtggagaaaaataaaaccccggcctctgagccggggtggcgcagactatagaatgtctgctgtcattttatgtgcggttgcctgaatatggaatgtcaaaatggagaggactgtaatggcgataatctgtctgattttaagccattggctgtcattcagttcttcaaaacggtgacggagacgctctgtctcctgttcggcgatctcctgcagatttgattctttcatggaaggagtatcttggtgatggatggcatcaagcacatatgcgcagctttcataataagcaatcgggctgatgacatcatcagatctgtctgagattgtgttaaaggccacttttaaaatagcccgtatgtgttcaaagtcataaatggattttaaatcacgtacaattaaaagaataactgcctgttcaattgagtattttttgcccagctcagggtgtccgatcagatctttgatatcacgctttacccagttttgaatcgcggttgactttaacgaagtcagctcgcataagttgccaagctctacgatttcatttgtagacagaccgtattcttttttctgtttttttcgttcgtatcttgtaagaaattcaggaatttctagatgattggctgctttttctgctgacatgttcgctgattggacgagaatgtcgagcgggctatgttctccttgtccttttagggaatagagcagccgcaccatatcggttcgagagagtttaaaaatgttcattgttcacctctttaaacaatttgacgcggatataggtctatgtataagttcaaaattcaagcgtcagcaaattacattaacatcatacgtcgaattccttgcattttcaaatggatgttttataatttaaatatacgagttcttttgaacttaaaataacggaggttgttatggcgaaaagaatttttctgtttattctaacgaatattttggtgcttacaacaatcgggatcgttttgtctgttttaagctctgttacaggagtcgggacgtactttacagctgatggcggtatcgatccaatggcgcttcttgtgttcagtttagtcgttggatttgtcggttcctttacgtcttttgcgatgtccagatggatggcaaagacgatgatgggcgtcagagtgctgaatccgaaaaaacactcgctcagctatgaggaacagcaattggttgatcgtgttcacagattaagccgctctgccggtttaacgaaaatgccggaagtcgggatttaccgttcacctgaagtaaacgcgtttgcgactggaccgtcaaaacgccgttcacttgtcgcagtatcgtcagggctgctggatcagatggatgacgcagcggttgaaggtgtgcttgcccacgaggtcgcgcatatcacaaatggtgatatggtaacaatgacgcttttacaaggtatcgtgaatacctttgtcgtctttttatcgcgtatcgccgcttggatagcaagccgttttgtcaaagaagatctagcgccgatcgttcattttattgcaatgattatttttcagattgtcttttcgatacttggcagcctggttgtgtttgcgtattcacgccatcgtgaattccatgctgacagaggaggagcggatcttgccggcaaggacaagatgattcatgcgctacggacgcttaaaagctattcttcccggattatggaagacgatcagacagctgtccaaacgttaaagattaatggcaagaagcgctcttcacttttctctactcaccctgatttagatgagcgaatcagacggctggaagctaaataatacaaacacattgttcctctgagagaattctcagaggttttttattttatccattgactaaaatcataaaaaaataagcaagttaagaaaatgtttcgtaaaagcctttaaaaatggacctaatatctttagaataattaccgtacttaaaaagagaggcagaaggattttacatgagattaaagtttggaaaattgatacaggccttgtcaccggcccagctgatcgcattatattattttcttgctgttactgtggccgttatattgctgagtttgccggcggcccataaaccggggcggattgggcgtttattgatgcgctttttacagctgtcagttcagtcagtgtaacggggctgacggttgttgatacagctgatacattcagcacaatagggatttttatattagcatttgttctgcaatttggcggaatcggaattatgacgctcggaacgttcatttggctgatcatgggaaaacgaatcgggctgaaagaacggaaactgattatggttgatcaaaaccaatcccagttttcaggaattgtcaatctgatgaagcaagtactgtttctgatcttgtggattgaattttttggcgggctgatactcggcacatatttcttaacctactatgactcctatcaggaagcttatttacacggattttttgccagtatcagtgcaacgacaaacggcggatttgatattaccggtaattcgatgattccatttcgccacgattattttgtgcagtttattacaatgcttttaattatatttggagcgattggatttcccgtgcttgttgaagtaaaggatttcctgttttcaaagcatcggcgttatccatttacgctttttacaaagatcacgacgattacattcggctcacttgtcttgtttggagccattggcatctttgccctggaagcaaaccatgcgttcgcaggaaaatcatggcatgatattttgtttttgtccctgtttcaatcaacggcaacccgaagcgggggactggcaacaatcgatatcagccaattatcagattccacactcttttttatttgtgcgctgatgtttatcggagcatcgccaagctcagttgggggaggcatacggacaacgacttttgctttgaaccttcttgcgctgtttcattttgcccgcggcaataaggccgtaaaggtattcaaacgggagcttcaccctgctgacttgatgaagtcgcttgttgtcacgatgatggcgatcctgctcgtttttggcgcgaccctcattctgaccattacagaaaagcattccctgctggagcttttgtttgaagtgtgctcggcattcggtacaaccggcctgtcgcttggaattacggcagatttgagcagtgttggaaaatgtgtcattatgattgtcatgtttatcgggcgaatcggcatcctgaccttcctgtatctgatcggaagaaaggaaattgaagcgaattatcactatccaaaggaaagagtgattatcggataggcaaaacaccgcatattttgcggtgttttttgattgccaaaaaaaagatgtgtgcctcctgttcagttggagaacctaacttcgacaggtgcaattaacgctcctgcatcttgaagtgagtaaaatgtctgaaaactggcgaggaggattcgtatgaagcgtaaagctgaagtgaatgaagccattaaaaataacaatacacctaccgagagcatggaccccaattcatataagacacaatatcatgacgaccccaattttagaggggcaaaccgcaattccaaacagggccagcagggaggcatgtaattgtgaagaaaaaccgtcatagcagagacatgcaaaatcataaaaagcctatgaataaaaaggtgctggaggaagaattctcaagtgaacttggggattacaatgccggaaagatcatcgaaacgctggaagtcactaagcctgaaaagaaaaaagaaaaaaacaaaaataaaaaacaacaataaaaaagacctcttaggcggcgtccgcttaagaggtgcttttctattttaaataagcatttttgcccgttcctctgacaaattgcaataagctggtcatcctcagctcaatgaagggctgagcgactgtcttaacaaagttgctggagaggactgatgtaagggctgctgttaaaagcaagaggatcactaagctttgatagtcagtaagccaatcctcaagcccgacctgccgtaatgttttaataataaacccgtgaagcagatacacgtaaaatgtccgggttccccatctggtaaagaaataccgtttttgcggaacaagcgctaaaaagctgaaggttgccccaaaggcgagtacataccagccgattcgggatagtccgcttacaagggtaacgtctccaaatgaagaatacggttttgaaccaaacagaaaagaatagtcaaaatcgatgccccagcagatgacgaatactgcggaaagcactccgagcgcaatttgtttgccgcgttttgatctcaatagatcaaaatgatgtttatttaaataaaaaccgacaaggaacatcggtaagaatacgaatgtccgtgacaagctcagcgtgctgctgacaaagtccagataaccgatcagcacggcgattccgcagctgacaaacagcgcccactgctttgaaagctttgaaaaaggatataggagcaggttccaaaagaataagcttacaagaaaccataacgaccattgcggatcaatcgggttcacatttgccatgctttcatcttgcataatgtaataaaagacggaataaatgatttggaaaatcaaatacggaataatcagcttgaccgccagcttttttacatatcccgcccgtttaaagcctttcgcgaaataaccggatacaagaataaatgcaggcatatggaatgtgtaaatgaacttgtagaggtagagcataaaatgattatcattaataaaggaacgaaggatatgaccgaatacaacaaggaatatcaataaaaattttgcgttatcgaaataactgtcccgcgatttactcatagcatcaccttctctttcatcagtcactaagagattattccctgctggtacatattttaaaataaaagatgaaaaaggaatctaaaaaaatgctgattgttaggtcgatgtaaagtgacggtaaggatcgtagaaaatgtcttcgtaatgtaatggcgctgaaattttctgaaatttatagggcaaatgaaggaagttcccgcattttgtagaaatattgagggataggttttgaagaaggagtgtacatgcatggaaactcttggtgtccagacaaactcggagctgcgagaggaactgaatcgcctcaaagaagaaaacgcgcgactgaaaaaggaattgaatcagcatcaagtgattgtcaacaatacgctcgatgctatttttatttgtgataacgaaatgcggattgttcaggcaaatgaagcaacagaaaggatgcttcaagttgactcggaagatttgaaaaagcgttctgttttggattttttgttttcaatcccaaaggatgaactgaatctttccgtaaagaagttttttaaaaaaggctttctgtggaaggaggttccggtcaggcttgattgcggggcaacaaaatacatagagtttctggccaaaagaggcattggtgaggatttcttttttgttgtcatgagggacatatcttctaagaagattctggagcgggaattctctatgaatgaacagctttttaaggacttgtttgacagagcagttgacggaatcgtcctgtttgataaagatggcggttttattgatgccaatttgtccttttgtaaaagctttgaaatcaatcataatgagctgtctcatttatcgttgtatgagttcatagacagcggctcacgaaaagatttcgacaatatctggaaggcgctcaaccgcaagggaaaagcgaagggggagctgcctgtcaagcttcgttcaggagttcaaaaactatttgaattcacgattacatcaaacatcatcagcggtttttatatgtccattatgagggatatcacagagaagcggtctatggagctgcagctctttaaaagtgaggagcgcttcagagaaatctttgaaaatgcaatggacgccatcatcatctggtcgaatgacggaagaatcgtaaaagcgaatcaatcagcctgtaaaatttttgagctgccgatgaatttgctgttgaaaagaaagctgtgtgattttctcgttgactcgcagcagaaatacagcataacgaaaaggaaatacgcaaaatacggagagatcagagaagagctgctgtttcaaatggggaacgggcaattcaaagagcttgaatttacttcaaaacggacaatccttgaaaatcagcatttgacgatcttaagaaatgtaagcgacagaaagcggatggaaaaggagcttcgggaaagcgagctgaaattcagaaaagtgttcaacggctcaatggacggcaatgtattgttcgacaatcaatacaggatcatcgacgccaacccattagcaagccatattttgggactgtcacatgaagagatcaaacagcacagcctgttagatattatttctgcttatgaaatagaaaatctggcatcaccagcaaggcagattaattttgatgaaatggacaacgaaattccatttttgctgagcagcggtgataacagaaaactcgaattctcatttaaacggaatattattcaaaatatgaacttggctatctttaaagacgtaacagagcgaaaagaattggaggaacgcctgcgcaaatcagatacccttcatgttgtcggcgaacttgcagccggcattgctcatgaaatcagaaatccgatgactgctcttaaaggcttcattcagcttctgaaagggagtgtcgagggagactacgccctttacttcaacgtgatcacctcagaactaaagcgcatcgaatccatcatcaccgaattcttgattttagctaagccccaggccattatgtatgaggaaaaacatgttacccaaattatgagggacacgatagaccttctaaatgcgcaagccaatctcagcaatgtacaaatgcaacttgatttaattgacgacattcccccgatttactgtgaaccgaatcagctgaaacaggtttttatcaatatattaaaaaacgccatcgaagtgatgcctgacggcggaaatatttttgtaacgataaaggcattggatcaagatcatgttcttatctccttaaaagacgagggaatcggaatgacagaagataaattaaagcgacttggtgaaccgttttatacgacaaaggaacggggaactggactcgggcttatggtaagctataaaattattgaagaacatcaaggcgagattatggtagaaagtgaagaagggaagggcaccgttttccatattacgcttcctgtcagacagaatgctgaagaaagaaggaatgatgaatgaactactatacgacagccgaaacgccgctcggtgaacttatcattgccgaagaggaggaccggatcactcgtctatttctcagtcaggaagattgggtggattggaaagaaacggttcagaatactgagcacaaggaaacacctaatcttgcagaagcgaaacaacagcttcaagaatatttcgtaggcgaaaggaagacattctccctgccgctcagccaaaagggcactccttttcagcaaaaagtgtggcaggcgctggagaggattccatatggcgaatcccgaagctatgcggatattgccgctgcggtcggcagtccgaaagcggtgcgcgctgtcggacaggctaataaacgtaacgacctgccgatttttgtcccgtgccacagagtgatcggcaaaaaccgtgcgttaacaggatacgccggaagcaaaacggagatcaaagcatttttgctaaacatcgagcgaatctcctataaagaaaaataaaacatatggcacgttccctttttttcacggccgacatatcattttattaagttaaaaaagttggtctgatgaaaaaggaggacaaagcaattgaagccgagccgctctgagaaacttgccgtttttgccgaactgtttgtgaaactgcatatcttatcaagcgctcaaaaagatgaaatcatcaatgttaacaaaaagaaacaaaaaaaccgctgactcggctccaaatgagcaaagtccggcggttttttaatgcaccttttctcctctaaacagctgttcaatctcttcttcatagtttccggtcataatccctttttctgtgatgattcctgaaatgagatcatgaggtgtaatgtcgaaagcgggattaaagacaggcacattggatggagcggtccgaactccggaaatctgcctgacttcctcgggatcccgttcctctatcgggatatcagcgccgcatttgacctttgtatcaaatgtagataaaggtgcggcgacaaaaaacggaatatcaaaggcgtttgctaaaatagcaagaccgtatgtgccgattttatttgccgtatcaccgttctttgcaattcggtcggctccgacgataacagcggaaatttgtttttccttcatcgtatgggcggccatgctgtctgtgatcagagtgacatcaatgcccccctgcatcagctcccaagcagtaaggcgtgaaccttgcaggacaggccttgtttcacaggcataaatgtgcaatcccaaatctttttgtttggccaagtaaaacggagctagcgccgttccatagcggcttgtcgcgattgagccggcattgcagattgtcatgatcctgtcgccttttttgaaaagctgcagggcgttttggccgatcaaccggcacgtttcctcatcctcgacctgaatctgaatggcttcatggacaaggtttgtttttgcttcatttacggaaatcgcgttttcgaccgaatgactcagtctctcaagcgcccatgacaaattaatggcggtaggccgtgaactgtttaaatattgtttgatgtcttccagtctgcggcggaattccgtgacattatctgtttcaatgtttttggcagcaagcgccagtccgaaggcagccgtaatgccgatcgccggagcgccccttactttgagcgtgacaatcgcatcaaatacatcctctttcgtcgtcagctccaaatattccgtctcatcaggaagcttttgctgatttaaaatggtaatagctgtttctttccattcaacagaacgtggaacagcaaatgaatgggtcatgaatggatcattcctttacaagtaacttaaataattcaataacatctgttatcgttttgaattccgaacgtttttcgataaaggctgtgccggtttcgagcgccaggcgttttctgccgattcgtttatcaaacggcacgatcgtatccaggtcagctacatgggcaaggccgatcgtgcgtcgtatcagctcacagcccgcaaatccgattgcttcttcaaaaatatggctgagcgtatcagtgaggtaaccgtcgatgttggcgtaaacatccagactgtcattctgccaggcttcactaaacgtctcttcaaacgtttcccagacctggttgacatgttcatataacggctctctgtcagccccgtcacggctgagtgcgttcaaaaataagttggcgataaattgccctacatcaaagccgatcggtccgtaaaaagcaaactcaggatcaatcacctttgtttcgtgctcacttgcgaaaatgcttcctgtatgcaaatcaccatgaatcaacgtttctgcagacgttaaaaatgactttttcagcttagcggcttcgattttaacgctgtcattattccaaagcttttcgacaaaaggacgaagctcttcttcaaaatcatttgtgtcatggtcgaagaaaggatctgtaaaaacaagtctttccgtaatgtcgcatagctctggatttgtaaactgtttaacaagctgttttttcaccttaggttcaagcgcgtaatctgatgagtagaaaagtgtttttcctaaaaattcaccgatgtgctgcgacagatgaggatagttttcaccctcaatgagtccttttcttgcgatcttgaggtgagagagatcctccatgacggtaaccgccatttccgtatcagaataaaaaactcttggaaccaggtgaggcacatgctcgccctgacggatgagagcgctgctttcgattcttgcacggtcgattgtcagcggccagctttctcccaccacttttgcatacggaaccgcctgtttaatgatcaatgctctgtcatgttcttgatcataaatatgaaaaacgtaatttaagttgccgtctccgatctcctggcatgtcagcgtgcttttgcttggaaataggccaagcttcaccgccaacgccacagcggagctttcatttaatgtttcgtataaaggtgtttttgtgactcccatcatcataacctccaattatgtaatcacttaatatgtggccgtaaaaaagcctccttctcagagagaaggaggcttaacatctatgtccgcctctcttatctctcagatcagatctgaatggaattagcaccgtgccttaagagaccagcgtctcggcgcgaaaaagatgcgccccatttcacaatggaattacggtcggttgctgttggggtcaaaaggccaaatccctcgcccaactctcgataagagaatatattcacttgtttgacaattctaatttatcagttgatgaacatggtaacaggtaatttagttagttgtcaatatattttttaatataaatcttttctgatatcatcgaaaacaggaatgctctcccgaacttctgcgctttcttgaaggtcgatttccgctcggactatgccttcttcccggctgccttcagcaagtacacgcccccatggatcaataattaggctatgtcctgcaaattcattatccggatttgaaccggtacaattgcaggctgcgacaaagcattggttttcaatggcccgcgcaataagcaggcttttccaatgatcaaggcggggaagaggccattccgcagaaataaacagcacgttggcgccttttgtcgtatgttttctgatccattccggaaaacggatatcgtaacagatcaatcctgagcttttgacgccgtcaagctcaaagtatccgtcttcggaaccggctgataaatacagatgctcatccatcagctgaaaaagatgggcttttctgtactctttaatgatttgcccttccttatccgcgatgtacattgtattataaacatcagaattcttcctgacagcgaccgatccggcgacaatatgaacaccatgtttttttgccgttttcttcagccagctctgagcggagcggccgtcttcatcagcgagttcatcaagattggccaggtcatatccggtcgtccataattcaggcagaacaagaacatcagcatgtttgctttctttttcgatgaaaaattcagccttttttatattttccgaaggttttccgtatgaaatatcaaattgaagacaagatatcgtccatttcatctttttaacaccccaaatttttctttacttttttcatttaaccatatatgatgatggactatcatttcaagatttttttagaaggtgagaatagatgaaatttgaacagtctcatgtattgaaggaattgcctaaacaattcttcgcttctctggtgcagaaagtgaaccgaaagctcgcagaaggacatgacgttatcaatctaggacagggaaatccagatcagccgactcctgaacatattgtcgaggagatgaaacgagctgttgctgatcctgagaatcataaatattcgtcttttcgcggctcataccgtctgaagtcagcggctgctgcattttacaaaagagagtacggcattgatctggatccggaaaccgaagtcgctgtattattcggcggaaaagccggtcttgtcgagctcccgcaatgcttgttgaatcccggtgatacgatcttagttcccgatccgggttatccagattactggtcgggtgtcacacttgcaaaagcaaagatggaaatgatgccgctcgtaaaggacagggcgtttctccctgattacagcagcataaccgctgaagtaagggaacaggcgaaattgatgtatttgaattatccgaataatccgaccggagctgttgctacttccgagttctttgaagataccgtgcgttttgcggctgaaaacggaatctgcgtcgttcatgattttgcttacggtgctgtaggatttgacggctgcaagcctttaagctttttgcagactgaaggtgcgaaggatatcggcattgaaatttacacgctgtcaaaaacgtataatatggcaggatggcgggttggctttgccgtcggaaacgcttcggtcattgaagcgatcaatctttatcaagaccatatgtttgtcagtcttttcagagcgactcaggaggctgcagcagaggcactgttagccgatcagacgtgtgtggtagagcaaaatgccaggtatgagagcaggagaaacgcttggatcacggcatgccgggaaatcggctgggatgtaacagctcccgcaggttctttttttgcatggctgcctgtgcctgaaggctatacttctgagcagttctcagatcttttgctggaaaaagcgaatgtggcagttgcggctggaaacggcttcggtaaatatggcgagggctacgtcagagtcggacttttaacaagtgaagaaagacttaaggaagccgcttatcgaattggcaaactgaacctgtttacccaaaaaagcattgacaagaccctataacgatgggataattcaaaataatttataaaatctatattttcttatcaagagcaggcagagggacgagcccgatgaagcccggcaaccgacttatgaagcacggtgctaattcttgcagctagcggctgagagataagattcggacgagaaacgaaacctctttagacgcgattgcagtttgaagaggttttttgatatggatgaaaatgaaaggagctctggcatgagtgagttattagcgacatatctcctgaccgaaccgggagccgatacagagaagaaagcagaacaaatcgcaacaggattgacagtaggctcctggactgatctgccccttgtaaaacaggagcaaatgcaaaagcataaggggcgggtgataaaagttgaggagagagagggaactgctgcatcagaaaaacaagcggtcatcacaattgcctatcctgaaatcaatttctctcaggatattccggctttgctgacaacagtgtttggcaagctgtcgctggacggaaaaatcaaattgatcgatcttcacttctctgaagcatttaagcgtgcactgccgggaccgaagtttggcgtatacggcatccggaagctgctgggagagtttgagagaccgctgttaatgagcatatttaaaggcgtaatcggaagggacctgagtgatattaaagaacagctccggcagcaggcgcttggcggagttgacttgattaaagacgatgaaattttctttgagacaggtctagcgccttttgaaacaagaattgcagaaggaaagcaaatattgaaagaaacgtatgagcaaaccggacataaaacgctgtatgcggtgaatttgaccggacgtacggctgatctgaaagacaaagctagacgcgccgccgagctgggagcggatgcgcttttgtttaatgtcttcgcttacggcttggacgttatgcaaggccttgcagaagatcctgaaatcccagttccgattatggcgcatccagcagtcagcggagcgtttacgtcttctccgttttacggtttttctcacgctcttttactcggaaaattaaaccgatattgcggtgctgacttcagcctctttccgtctccatatggttcggttgcgcttccaagagcagacgcactggcgattcatgaagaatgtgtgagagaggatgcttttaaccaaacatttgcggttccgtcagcaggcattcatcccggcatggttccgctattaatgcgtgatttcggcatagaccacattattaacgccggaggaggcgtacatggacatccgaacggtgcccaaggcggagggcgagcgttcagagccattattgatgcggtcctagaggcccagccgattgatgaaaaagccgaacaatgcaaggatcttaagcttgcgctagataaatggggaaaggttgaagccgtatgacgactcgaaaaccttttattatttgtgattttgacggaactatcacgatgaacgacaacattataaatatcatgaaaacatttgctcccccagagtgggtggcattaaaagacggcgtactttccaaaacgctgtcgatcaaggaaggtgtcgggcggatgttcggccttctgcccagccgtttaaaagaagagattacaagttttgtattagaagatgcaaaaatcagggaaggctttcgggaatttgtagcatttatcaatgagcacgagattccgttttatgttataagcggtggaatggacttctttgtatatcctttgcttgaaggcattgtggagaaagaccgcatttattgcaaccatgcttcatttgacaatgactatatccatattgactggcctcattcctgcaagggcacatgcagcaatcaatgcgggtgctgtaagccgtcggtcatccatgaactttctgaaccgaaccaatatatcatcatgatcggtgattcggttacagatgtggaggcagcaaagctgtctgacctatgctttgcaagggattatttattaaacgaatgccgggagcaaaacctcaatcatcttccgtatcaagatttttatgagatcagaaaggaaattgagaatgtaaaggaggtacaggaatggctgcaaaacaagaacgctggcgagagctcgctgaagtaaaaagggaattggcagagagagattggtttccggcgactagcggcaatctgtcaattaaggttacagatgatcctttaacatttctcgtcactgcaagcggaaaagataaacgcaaagagacggttgaagattttctgctggttgatcaaaacggagagcctgctgaaagcgggcattctctgaaaccgtcagcagaaacgcttttgcatacacatttgtacaataaaaccaatgccggatgctgcctgcatgtccatacggtaaacaataatgtgatttcagagttatacggagaccaaaagaaaatcacattcaaaggccaggaaattataaaagcactcggcttgtgggaagagaacgcagaagtgaccattccgattatagaaaatccggcacatatcccgacgcttgcggcactgtttgcggaagagatttcagaagattcaggagctgttctgatccgaaatcatggtattacggcttgggggaaaacagcatttgaggcaaaaagagtgcttgaagcgtatgaatttttgttcagctaccatttgaaattgaaaacactccagcatcagctggttaaataaaaggaggaattgaaatggctacaattcgaattcatgatgaggcaaatacaacgattgaaaatcaagaggaagtggcaagctttctggacagtcaagaggttatttatgagcaatgggatatcacgaagcttccggaacatctctcagagaaatatgacctgacagaagaagaaaaacagcaaattcttgataccttcgaaactgaaattaaagatatctcaacccgccgcggctataaagcccaggatgttatttcattgtcagacagcaatccgaaacttgatgaactgcttgaaaactttaaaagagagcatcaccatacagacgatgaggttcgttttattgtaagcggtcacggtatttttgtcattcaaggcaagggcggcacgttttttgatgtccgtttaaaccctggagatttaatctctgtgcctgagaatatccgccattacttcacgcttcaggaggaccgcaaagttgtcgcggtgagaatttttgtcacaactgaaggctgggttccgatttatgaaaaagacagcgtgaatcaataagcatgagaaagccccgttcatcgaacggggctttttatatttattgcaaacgccacttttcatactgtgacagttcttttttaatcagtgtccaaatcaaacttaaaacagctgcatcgtcaatgaacccaagaccgaggattacgtctggaatgatatcgagcggcatgacgatatacaggattgcggcagttaacagcaaaagtgttttaacctgtgaacgagggtagtcgccatttcgccaatcgcgaagcatctgaaaaaaagtagtgatgtgctgaatacatttttttcggtttttccttttcaaaattgcttttccgcctgccgctccgagcataattgctttctttttcttcattgggcatacctcctgcctggcggcgtgtttaagatattcttcacctgggtattgttcttctaatcctatcaatatatctattatacctgaaaaattaacttatttaatgaaaatatgtttacaaataaagtataatctgtaataatgcacaataacccaatcaaacttgtttcctatttcttagcggcgaggggtgaagtgaatgggcggttcttctgaacaagaaagattgttggtgtctattgatgaaaaaagaaagttaatgatagatgccgctagaaagcagggatttacagggcatgacacgatcaggcacagtcaggagctggattgtttaataaatgaatatcaccagcttatgcacgaaaacgaacattcccaaggaattcaaggccttgtaaagaaattaggcttgtggccccgcagagatgttatgccagcatatgatgcaaataaatagcggcctatcagatgcatatataaagagagagcttttcggaagcgctctttttttctggaaaaaattcatatgaaagagggaactaatgaaagaactggcgattctcattaccgaaatggtcaatcaatttcatgatgcttttatttccttatgcggaatatttggcattcatttaactgacaaagaaatgcatttttgggtgatcggcatttttggcatattctttttcggcgtcactcacgctgtgtttacatggctttctaaatggagtatgacagccttgtcctttatctataccgttacagtcatcattgtcatcgtatttgcgattgagattcagcaaaaggtgacggggagagggaatatggagtttttagatgccacggaaggtataaagggttttttagtattttttatgttttttttgcttttgaaaatgctgttgcgtttcatcaaagtccttttttctggaagaccagcaagcaaatcgaatggcaatgcccgatcacgaagataaaaaaccctcctgacatggtcagggggctatgaagcggatacggggagggtgattgtcacctctgtgcctcttcgcacttcactttcaatatgaatagagcctccgtacatcagcacgatccgtttacaaacaacaaggccgagcccggttcctttttctttagaagtaacaaagggaaggaagatgtgatccagcatttcctgagaaatcccttcaccgttatccacaactttgattatggcttttttatctaaagctcccagggaaatcgttagtttgcctccttcaggcattgactcgaggccattttttgctacatttaaaatcacttgtttaatatgatcttttgtacattttacgagtaagggctgctcggttaaatactgtaattcgacttcaacattgtatagattgccctcagaataaatgatcggcataatctctccgataatgtcctgaagtgagttcagctcccatttttcagctgtcggcttgccgagaacgagaaactcactcactatttgattgatgcgctttatctcctgttcgataatggagaagtaaagctgatcttcctcacctttatatttcttttgcaacagctgaataaagccgcttatcccggtgagggggttacggatttcatgggctgtgctggcagcaagcgtcccgatcagctctaatttttgcgcctcgttttctgagcgctccagctgggtctgccgcttcagcaaataatacagcacgagaataaaaaggatattcagcagaacaataatacatgaaagcggaagcactaggcttttcgtcagttcttctattgtgaccgggttcggatagactttcatattccagctgatatcatccagatatccgctgacaggtttctgatcctctgcatgagaggcttgtccgctcgcaaaaatcattttcccgtcttggtttacaacttcaatataaacatcagggcttagtaagttaatgagatttttcaaataatcaatttgaatagctgcgacaagataatctgtcacattacgttttgagtccaaaacagggacacaaattgtgaaaattggctgaccagtaattctgctcgaataactatctgaaatgactgtctttttagtttcctttgcttttgtaaaaaaagatctgtcggccaggtttactttcgtttttaattcggttgtgcttgcggtgacgtctcctttggcattgagaaaatagagaccggaaaatctcggctctgaatcaaaggtcttttccaaaattgactgcattttctttatatcaaccggtctgtcgatggcgatggacaaggaggtcattctcgccattgtttctccgattaaataattgattttgttgcggtgaaggtttagcaggacacttgcttcttgtttatgttctgcagctattgtatctttttctttttcatatacgaaaaagctgatgacgattgccggaatcacgaccagtatgatataaagtttgactctcccgcaggcgccttttagtattttcaatttgcatcgctccaacatacacctgattagaggtattatatcattgtttcttcttctttaataagaaaaaataaccaaaaaattagaaaaagatgttggcaagcttacattttaaaaaagaagagaaatattggaaagatttttattgacattttggtctttgtttattaatgtttctctgtaacggtttctaaaaggatgattgagacatgacagaaaaatcactgaagttatttatcgtgctgtcgcgcgcgtatcggtctattaacgatcatatgaataagcatattcataagcatgggctgaatccgactgaatttgctgtgctagagcttttgtaccataaaggcgatcagccgctgcagcagataggagataaaattctcttggctagcgggagcatcacatacgttgtagataagctggagcaaaaagaacttctcattcggaaagcgtctcctacagacagacgagtgacatttgcgcaaattactgaaaaaggcatcggtcttttgaacgatattttccctgatcacgctgctgaaattgatgaaatgatcagcgtattaagcgaagaagaggtagagatgtgcaccgaaatgttaaaaagagtaggattaaacgcaaaacagtttcataataagtaaaaaaaggaagcctgatatgtcacaaggcttccttttttgctatttttcatttgtttccgctgcgcctctcggcaaaatgagaacttcaacccgccggtttttgcttcggccttccgcagttttattggaagccaccggtttatactcgccataacccttggcgctgaacacttttgcatcgagcttggggttttcaatcaggagccccataaagtttaccgctctcatgacgcttaaatgccagtttgattggaattcagaatttttaattggcatattatcagtatgtccgctgataatgatatttcttggcgggttaatcacaagaagatttgaaatctcttttgcaagcggcacatcttccttacggatggtcgcttttccagaatcaaagaagatgctgtctttaatcgtaatcagaaggccttcactagtcatcttcgtctccagctgatgttccagctttttatctttgatgaacttttccacctggctcttcacattttcaagttcttcttgatcagctgctttttctttttctttcttgtttttctctttctcttctttttcctttttcacttcatcgatgccgtctgactcgttttcaggaggagtgacactggagtagtccagtacaccggtgccgcctgtaaaaacttcattaaatgattttgagagcatttgaaacttagctgcgtcaatcgagctgctcgcgtacagcacaataaacaatgccaggagaagagtaaggatgtcggcgtaaggaacgagccatgattcatcaacgtgctcgtcctcatgcttcttcttcttttttctcgccattttgcgcctctccttgttctgcaaatttcaagcggtccttcgcaggaagatacattaaaagcttttgttcgatgactttcggtgcttgtccttctaaaacggataaaacaccctcaatcatgacctcacgcagttttacttcttgttttgattttcgttttaatttatttgcgaaaggatgccataacacataccctgtaaagataccgagaagtgtggcaacaaaggcggcactgatggcgtgtccaagctcatctgtattgtccatatgagagagagcggcaatcagcccgattacagcgccgagtactccaagtgtcggggcgtacgttcccgcttgtgtaaaaatagcggctccggcttggtgcctgtcctccattgcttcgacttcctctgtcataatatctctgataaattccgcgctttgcccgtcaacagccatgctgagcccgtttttcaagaaagcatcatctacatcctcaatgcttgcttctaaagcaagcagaccttcgcggcgtgcaagctgagcccattcagagaacataggaatgagttcctctattgtgagctgtttattttccttaaataacactcgaaacagcgcaggcacttttttaatttcttttgttgggaacgcaataacgactgctgagattgtcccggcgataataattaaaatggcagcggggtttgcaagggcgctgaaactgacgcctttcagaaccatcccgacgctcaatgctacaaaagcaagaataataccgattaacgaagttttatccatagttttcaccaaatccttttttactagcttgtctatggttaatatcggttttggtgcccggaactttagggacattgtgaatttgttcatgaaatattcaaggaagaggcatagaagggagaaataaacaaaaacgggctctccaaaattgaaaagcccgggggtctactgaaattggcagctttcttgcaagctgtccttcagatggtattcgtataatagtagaaatacatattcactgtatataaacatgttccatccctccttaaaaaaagtgtaaaggatgaagggaagtagcgcttcagggaaagggaccgtattttctaagtcaagagtatgaaagcataaaaaaagcggcttcctttaaggaaaccgctgattgttatttcgctcgcactttgattttatcatcttctaaaatcacgtgaaaacttgtgatctcgccattatcaagcagcagatcggtcatttcatcctcaacccattcttggatggttcttctaagcggacgtgcaccgaatgaagggtggtagcccagctcagcgattttttctttcgcttcatctgtcacattcaagctaatgccccgttcagccaatgtttcttcaagttctccaagaagaaggctgacgattttgacaagatgttctttttccaatgagcggaactcaataatgctgtcaaaacggttgaggaactcaggtttaaagaacatgctcagtgaatcaattaatgtttgttcttcgatgacactgtcatctgattggaaaccgactttcgtttgtttctcaccagcacccgcattacttgtcatgatgatcactgtgtctttgaagcttacggttctgccttggctgtctgtcagacggccatcctccataatttgcaggaacatatgctgaacgtctgggtgtgctttttcaatctcatccagcaacacaatgctgtaaggattgcggcgcactttctcagttaattgtccagcttcctcatggccgacatatccaggcggtgaaccgataattttagatacggcgtgtttctccatgtattcgctcatatcgagtcggataatagcgtcttttgtgccgaataattcatctgccagtgttttagaaagctctgttttccctacgccggtaggacctacgaagaggaaggagccgactggtctgtttttggattttaatccggcgcggcttcgtcttaccgcttttgccactttttgaacagcggcttcttgtccgatcacgcgttcatgaagttttgcttcaagctctttcattttcgtttgttcgtctgcctgcagtttgccgacagggatgcctgttttttgttcaataatttcctgaatgtgctcagcttccacagtgacagcggtatgagcggaggagctgttcagttttttctccaatgcgagttcttcatcacggagttttgccgccagttcgtaattttcttcttccagggcttttgttttttcggcttcaattgcagttaagcgttcagcggcatcctcatcattcagttcatcaattaacaggttggcttttgaacctgcttcatctaataaatcaattgctttatccggcaggtgtctgtcctgaatgtagcgggatgataaagtgacacacgctttgattgcttcatcactgaatgttacgctatggtatgcctcgtatttgtctttaatcccttgcagaatgaggatagcctgttcaattgaaggctcctgcaccatgacaggctgaaaacgtctttccagcgcggcatctttttcgatttgacgatattctttcagtgttgtcgcgccaatgacttgcagttcgcctctggctagggccggtttgagaatgttgccggcgtccattgatccttctgcagagcctgcgccgacgagaaggtgaatttcatcaatgaacagaatgacattttttcgttccttcagctcagtgatcagctgtttcattctctcctcaaattggcctctgatccctgtgtttgcaacaagggatgcaacatcaagcaaatatagctctttgtttttcagtttgtttggaacatcaccttcagcaatttttaaagcgagcccttcagcgatggcagttttccctacacccggctcaccaataagaaccggattgtttttgttccggcggtttagaatttcgatcactcgcgccacttcatcatcacggccgatgacggggtcaatgagaccggcttttgcaccgtttgtaatattttgagccagctcatcaagcaacccttttttttcgctttgttttgctgcgctctgttctttcggctggaatgcctgttcaaacggaaatccgaaagattgaggacccatactcattgaaggtttacgggtcagttcgttatagcaagtttcacaaagaaccatctgtttatgaacggaatttatttgcatgttaaggcgaatcgtcgcctcgttttgatgacaatgttgacaacgcatttgccaaaacctccttaataatttgatcatctttgaccaatgaaagtgaataaaaaggtctattggatttgaccttctttgactattagtatacggcaaacttaacggcattcaaaccaatatgctcaaagcagactgaatatttgactatctttgaccaattgatttttaaaaaaggccggtttgtttgaccaactttgattaatagtatactctgactatctttgactttcaagtcttatgcacaaaaatttttgatttgttacaaagtaaaacatgttttcttcgtcttttcaaggaacttgtctcataggttataaaaaggcatatatggacaaaactgcggttcgttcggagggaagaaatggaacaatcaaaagggtctgcaagtcagcttgcttttgtgtatgtcggcacagtagtcggagctggatttgcgactgggagggaaattgttgagttttttctgaagttcggctggttcggtttattcggcattctcgtcagcggcggaatgtttacgttactgggggccaagctgatgatcatttcaaagcgaatcaatgccaagtcatatcaagaaatgaacatatttttgttcggggcgacggctgggcggattatcaatgtatttatgctgtttgttctccttggagttacatctgttatgctttcaggggcaggggcgctttttgaggaacagctggggatgtccgctcagattgggatgctcattacaatcggtctgagcttaattgtgatgactagaggagtaaagggcattttcggtgtcaatgtgtttgttgttcctcttttaatcatcttttcaatgattgtggtggccgactcttttatattcagcgaatcacgtaacgcagctcagtgggtctggccacatcgctgggattggctgttatcagcagtttcttacggggctttaaatttatcgcttgcccaagctgttttggttccgctggcgaatgaaatgtcatcggagaaagtgataaaaaaaggcgctttaatcggaggcacgatgctgacgattgtgctgtccgcgagttttctgtctttgtcgactcttccggatgtatttttgtatgatataccgatggcgcaagtggtttatctctttgcacgatctgtccatttgatttacttactcattattttcggagaagtgtttacatcagttatcggtaatctatatggattagaaaaacaagtgcaaagctttcttccagtgaaaagcaaatatatctttgcagccattatgatcacggcttatattacgagccaaatagggtacggcaggcttatttcaacgatttatcccttgtttggctatgtgagcctggccttcataggcgctttgctttgcaaaaaagctcctcggcggcgcagtttataaatatatataatgaaacgaaccgtcactatagagcgataattgatctaggaaccggggactgacttttttattgtcaagaaaaacaacattatggtaagatagcagaagtgaaaaaattgaagaaaatccgtgcgatatgcgggagaggttctagctacaccctctataaaaaactaaggacgagctgtatccttggatacggccttttttatgtttttctagagcaccttccgaaaaaaggtgtttttttgcgtgaattagctgtagcgatatctctcgccgacgtttttattgcggagaaggagaggaatcatgaaaaaagaaaaagcaattgtcgtatttagcggcggtcaagacagcacaacatgcttactgtgggccttaaaagaattcgaagaagtcgaaacggtgacttttcattataatcagcgacattcgcaggaaattgaagtggcaaaatccattgcggaaaagcttggtgtgaaaaatcatttgcttgatatgtcacttttaaatcagcttgcaccgaatgccctgactagaaatgatattgagatagaagtaaaagacggagaactgccatccacattcgttccaggccgcaatttggttttcttatcctttgcgtctatcctggcttaccaaattggcgcgcgccacattattacaggagtttgcgagacagacttcagcggttatcctgactgccgtgacgaattcgtgaaatcttgcaatgtcacggtaaatctggcaatggagaagccgtttgtgatccacacgcctctcatgtggctcaataaggcggaaacgtggaagcttgcagatgagcttggcgcgctggattttgtgaaaaacaacacgctgacatgctataacggcatcatcgcagacggctgcggcgaatgtccggcatgtcaccttcgttcaaaaggttatgaagaatatatgatgatgaaaggagagcgtgcataaattgttatctcaaatttatccgcaggcccagcatccatattcgtttgaactgaataaggacatgcatatctcagccgctcattttatccctcgggaaagtgcgggagcgtgcagcagggttcacgggcatacgtataccgtaaatataaccgttgccggcgacgaacttgacgattcaggctttcttgtcaatttcagcgtactcaaaaaactggtgcacggaaactatgatcatacgctattaaatgatcatgaagatttttctcaggatgaccggtattcgctgccgacaactgaagtcgtggcgaaaacgatttatgacaaggtgcaggcttatttagacactttggagaataagccgacctgtgtacaggtgtttgtccgtgaaacaccgacaagctactgtgtctaccgtccgaaaaagggtggtttgaatggctaaaggaattcctgtattagaaattttcggcccgacgattcaaggagaaggcatggtgattggacagaaaacgatgttcgtccggacagccggctgcgattattcctgcagctggtgtgactccgccttcacttgggacgggtctgctaaaaaagatattcgctggatgacggcggaggagatttttgcggagcttaaggacattgggggagacgcgttttctcatgtaacgatctcaggcggcaacccggccctgttaaaacagctggatgcttttattgaactgctgaaggaaaataacatccgtgcagcgcttgaaactcaagggaccgtttatcaggattggtttacgctgattgatgacctgacaatttctccaaaaccgccaagctcaaaaatggtaacgaactttcaaaagcttgaccacattttaacttcacttcaagagaatgatagacagcatgctgtcagcttgaaggttgtcatctttaatgatgaagatctggaatttgctaaaactgtgcacaagcggtatccgggaatcccgttttatttacaagtcggaaatgatgacgtgcatacgacagatgatcagtcactgattgcacatttgcttggaaaatatgaagcgcttgttgataaggtagctgtcgatgcggagctgaatctcgtcagagtgctcccgcagctgcacaccctgttatggggcaacaaacgcggagtataatagaaaggaagatgaacatgacgacaagaaaagaatcagaattagaaggtgtaacattgctaggcaatcaaggtacaaattatttgttcgaatatgcaccggacgtgctggaatccttcccgaataaacatgtaaaccgtgattactttgtaaaattcaattgcccggaattcacatctttatgtcctaaaacaggccagcctgactttgcgacaatctacatcagctacattcctgatgaaaaaatggttgaaagcaaatcattaaagctgtatctattcagcttcagaaaccatggtgacttccacgaggactgcatgaatatcatcatgaatgacttgattgaattaatggacccgcgctacatcgaagtatggggcaaattcacgccaagaggcggaatttccatcgatccgtacacaaactacggaaaacctggcacgaaatatgagaaaatggccgagtaccgcatgatgaatcatgatttgtatccggagacgattgataatcgttaattattccgttgtgtgatacggagtgtgaaacgaagtggagtcacagtaaaatccgaacattcagtgctaattttcagcggaattgtgaccgagtcacagcgaattgtgaccggagtgtgacccgcactaagctcaataaaagtgggaaaagtcaaacctgaaaatggctctactcatggaaattgtattaaaaagtgtcacctgaggtgcaacctgaactgtgacttttatgcagtgaaaaattgatagtacagaagcagattaaggcgtacaatttgtacgtcttttcttttttatccgaatgaaaaaatgcctatctagagatcataggcattaaatattattatcaatatcttcatttattttttggctaagtttctgaaccttctctttaacatttgaaacagctcttttttgaatttcatcaaagttctcctgaatatagtcgatgacacttcttattagaacttcactttcaaaattgaatatctcatttatttctgactgttcttcatctgttaggtgatggtattgaagttgtttagcatttacttcagcagctacatcaatactaacttagttgttctggttgtacaatttcatattcaccttctgtatactcttgctctgcataatggcttccccattgacagagctcctgcaagataggtttaagagattctccaagttcagtggatgaatattcaaccttcggcggtacttgattatacatctttctgctcacaagtccactggcttcaagctctctaagtgtttgaatcagcattttctgagttatatttgggataatgcgctttaattcactcgttctctttggtccattcattaaaaagtataatacaaggcctttccattttccgccaataacttcctttgtcacttcaaacccacaactaaattttttcattgtctaaagctctccattccacatttattactttttagttactatatcacaaaaaagtgggtacttccgataatgtgcttactgaaggatactatatcttgtaagttgttcttcaagtacttaaaggtactagacataaaataaaattaattctaaaggagtgttaagtatgggtaaatttgaaggtaaaatagcacttgtaacgggtggaacaagtgggattggtcttgctacagcacaaaaatttgtaaacgaaggtgcatatgtttatatcacgggacgtagacaaaacgaacttgataaagctgttaaccaaattggcaagaacgtaaccggtgttcaaggtgatatttctaagcttgaagacttagacaaactatatgacattataaagcaggaaaaaggtaagttggacattctttttgctaatgcaggcatcggcaacttccttccattaggtgaaattactgaagagcaggttgatagaacgttcgacattaacgttaaaggaaccatctttactgttcaaaaagcgttatcactattcccgaacaaagtaggttctattattgtaacgggctctactgctggatcaattggcaacccagcgtttagtgtatatggagcatctaaagcagcattaagagcactggttcgcaactggattcttgacctaaaaggtactgaaatccgtgtaaatgtggttagtccaggaggtattcttacacctgcctacgatgagctttttggtgatgcacttgaagaagtaatggaaaatagcagaaatactgttccagctggaaaagttgggacacctgaagaagtagcaaacgctgtatctttccttgcttcagacgaaagcagttacttgacgggtgttgaattgttcgtagatggcgggctagcacaggtataatttcactgcacagagattacaaatagtccccaaaaaaggttaatggggatttacttgaagaagtcgcataaaaaagtcgttttccttaaaggacagggaattcgacttttttatgtttgaatttgattaacgttgtaaattcgcattttcctggggctaccactaaatgacctgtaaaaaagattactttgtgaataaatgtacttaaagtaacgggggctcttgacttttaataaaaaataatatccctgtccttgtattctaatacttttgaaaatatttaaaggaatccttatgtcctgaataaccacataggaaaatatgttgtaggttgctttctttttttgggggcatcccacacaagctatcacgtgatctcacacctgaacgtttttttatagactagtaccgcgacaagttatattacatatacataccaataaagtagacattaaaaagtgaaagagaggatggaaatgtgtgaaaattcttttccttgagagtcatcccatgtggctctatggtttaccgaatgggtttagggaagcaggacataccgtaatgatttccggtcctgtaagtcgggaaaatatcactgaaatgatagacgaatttaaaccagatctaatagtatctatgggatggacaccagagcattcaagggaaaagcaggcctggattcgcagcgctactaaaaaggtgaatatccctctcgtttattgggcaactgaagacccgctgcacactcaaaactttactatcccgttaattaaaaagatgaaaccggattttgttttcacggttacgccttctctgtgtaaaacttatgaaagcatggggattaaagcagctcacttagactttgcatttcacgaaagtatacatcaccagattaaaccattagcaaaatacagttgtgatatagcggtggtggctaatgcttaccctaattttcttgaagaacatccggatgtgttccgttcgtcctctttaaaaacgcttattcgtcctcttatacggaaaggtattcgtattgatttttggggagaaactgggaaaaaatgagtaaatatataggaagagaaattccccgcaattggatccatggataccttgattatactgaagcatataaagtttacagttcagcaaaaatcattatcggtttgcaaaactgtgaaagccaacttacgcaacgcacctatgagattcttggttccgggggtttttattgacatcggctacaccagcagttcgaggtaaattcaaacctggccgcgatctcatcgtttcttcctccccaaaagaaacattggaaaaggttaaatactatttgaatcatgatagcgagagaaaaaagattcagataaacggtaaaaaggctgtaaagaatgattcctatcggcatagagccgagagaatgcttgaggtgctaaaaagcagaggaattataagaaacttaggggaaaccattcattatgtagatgttctcaaagaaaaatacgtgatccatcatgttactcccggtgaaacattatcaataatttccaggaagtataacgtttccctgcagcaactcatggagcttaatcatttcaaatcagatcaaatatatgctggacaaatcattaagattagagagaaactgtttagaaatattaataacaaatttttctaaaggagagtaatatgaatgaaggggaaaataccaaaaataagaaatcaagcgaataaagtaaaaagaacgcctcgttatatggaatttccagtgacatacgaagtatatcatgtggaatccggcgatacattatggacgattgccaaatcctttaaaattccagtacaacaacttatgaatcttaataagctttcttcagatagaatttatcctggacaaattataaagataagagaaagataatctttgaggtttcggaaacgaatcaaattgaaatgacaatcctcatttttttatttgtggggaacttgatatttttggggatgaaggggttatgagatgtttcaaatgagctatttctattctggattaggatgggattttattcaacacgttgatcaaacgaacggagtattaaatgttgtgtctcctgattttttctatatcagaaaagatggatcattacttctccgttcagctaatcccgatgtgattaaagctcttcatagaagaaaattaaaagtagttccttttctaagcaatcattgggatcaggatttgggacgatttgcattaatgaaccgagttcttttagctaaacaaatttctcatgcaatagaagaactggatttggacggagttaatatcgatatagaaaaccttacagaaaaagatcggaatctatttacagattttattagattagtaaggaaaagtattcctagacataaagaagtatcagttgcagtggcggcaaatccttttggctggacgaagggctggcacggatcatatgattacgagtatttagctaaatatgcagattatcttatggttatggcctatgatgaaagccgtcttgctgggcctaccgcaagtgtaggatgggtggaaaagtccattcaatatgttctgacccaaaaaatctctcctcaaaaactagttttaggattgccattctatggccgctgctggatggaaggccaatctgcctctcaagccattcccctttaccttgttgactccttagtaaaaaggcatagcgggacaattatttttgacaccaagagtcaatctccaaaagctatttttactgtcaatcacaataacaaggggccgttgccttcgggaacatatacattatggtttgaaaatgaacagtcactcagagcaaaaataaaactcgctcaaaaatataatctgaaaggtcttggcagctggagtcttggacaagaagatgtgtcagtctggaatacagtgtttaaaaatatataatgatttatagttcagaaaaaaattcgaagataattgcaatgaatctctaaatggacatactgaaaggagtttattacgggtgcgggtaaaacagtgagggcattccataggcccttctcccgaaatgttctatacgaggcattacattgggcttgaaatacacattcaaacttatgttatagtacgcatttcaagtaattacggatgtgttgaatttattctgcttccatgattcaagtcatacacatgctaccttgatagcaggattattgcgtttcattcagaattgttcaggatcgatatggaagcgcacgaataactagaactttaaaagcatacactcatatacttcctgaatggatgctggtttatctaaaaaacatgatgagaattgattgaccgctctcattaaaggatggggaaatccaaggcgccaaggtacgcatggtgaaacatgacttgttgataatcgaccatatagtttctccttagaaatgaggcggtttttacataaaaaagacgagcgaatccggggggaattccactcgccgctttctaatgaaaagacgggatgctggatggcagctcgtctgttttattataatttaacgaacgtatgtttgtaaagatgtcttttcgaatgaattggttcatataaccgttaagaacagattcattgtaaacattcgctaaggtatgctaagatgcatggactataaaggagtgatatgaagtgaagacattgcggttaaacaatgtaacgttagaaatggctgcatatcaagaggagagcgagccgaagcgaaaaattgcatttaccttaaacgttacgagtgagacttaccatgatatcgctgtcctgttgtatgaaaaaacgtttaatgtcgaggttccggaacgcgatcttgccttccgggggaaatgacaaattattcaacatcattgaccaacctgtacgaaccaggggccgtcagcgagttctatatagaaataacggaaatagacaaaaacgccgattcatgatcggtgttttttatgtaaaaaagctgccggccggcagcttttgagaaagcgaatttcatatgtaaggtgttaaattgtccgtcttgcagttttttgaataaatgtggaaataaggaggttttaataggagtctctgatgatcttataatttttatgattaacaactgtcaatgaatctaactcaagatcccgatagttatccatgatcgtcacatcaacgataacagaattctcatttactttttcaacaacaccggttaatccgtttttaaattcaatgacattcccaaccttagcgattttcacaagcttcctctcctttaaacataataatgccttttgaaagtattttgcagtattttcattgagaagtaaagcgataaggagttttatctcccttatgaattgttctgtcgctataaagatgatatattgattttcgtcaatagaaagaaaaggggggaatttttgttgcgacccgaagaaataacagaaatgattgaacagctgcgcaccggcgccataaacgaactgagagtccagaaagagcattttcttgatttcagggccgtgttatctaaacaagatgattttaaacatttccgaggaattgcccagcaaggcggagatgttatttttcaatacttagaacagccaagaagctgaaggtttctcatacgtgagaagcctttttatcatatatgacagaatacaagccttttattacagctgtctgtaacaggtgtaaataaaatgtaaagtgtcaaagatggataaacatgttttaattttacaatatttatagaatttcagactgtttttttgccattaagcagtgagtcatcctctttattccatcctgatacctccttgggagagttggaaaatctttttccgtgaaaatgaatggatctcttgttaaggttatgaagtgttttttggagcactttaaggaggaaactgtatgacaacgaaattcactgctctggctgtttttcttctttgtttcatgcctgcagccaaaattgagcatacacaagcttcactactgagcgcaaagaagacaaaacatgaagaagcgaaatggcttacacatatagatcgaaatacgaatgaatctttcccttcactgtctgctgataaagacaagaaaataaaaccgattaagctatcagcacacactgaaaagaaagagaaagataaaccgaacaaaacaaatgatgagaaagaaacatatacacagtctgaaaaagagttgctgtcccgtctcgttcacgcagaggccaaaggagaatcatataaaggcaaggtcgctgtagcaagcgttgtactgaacaggacggagaaaaaaggttttcctgatacgataagaggagttatttatcagaaaaacgcctttgaaccggtcgcaaacgggagcattaaccaaaagcctgataaagaatcgattgaagctgccgaagaagcgctgtcctcaaaaaatagagaaacagatgccatattcttttataatccgaaaacagcgtcagataattggattcgttcaagaaaaatcgtagaaaaaatcggcagacacgtttttgccgtctaagcatagaagagacaatttgtctcagctgtgctttttttcatataaagagtaaaaataaaataatttttgaacttgtctcatatgatgttggtagtacaagagacaaggagagacatcatgaatcgatttgtgaaagggatcattcttttatccattgccgcctttttcgctgaatgccttgaatttgtcgtcaatatgattttggcgcgggagcttggcgagcatgggatggggctttacatgagtattttgcccacgatctttttaattattgtcatcgcgagcctggaactgccgatatccatttctaaattcattgccgagtcaaatcctaagcttcatgaaagcatgctgaggcacgctttcagaatgacagccatttttactgctttttctactgctgccgctagtattgcgcttccgtttattccggtatttgatacataccacccgtttattaaagggattgtcatcggcttaattcctgttgtcgcctttacttcaatcgccaggggctactttatgggtgtgcagaaaatggggaagatcgcaattgccaatgtgctgaaaaaaatcatccagctcttgtgcttattcctcttttttcaatggtactcatttgaattggacatggccgtgctgatttccttgtttgttctggtcgtgagtgatgtggtcgtgcttgtttatttatattcacaatttatcatggcaaggcgggcgttatccggccagcagcacattcatttgcgcggaaaggatgtaaggaaaagactgcttgctgtttcaattcctacaacaggactgcgtatttttcatgcggttgtcaatgcaattgaaccctttttagtaaaaggagctcttttggctgcgggtgttgccgggacagcggcgatcgatcaatacggaatgctggcaggagtggctgtgacgatagggtcgttccctgcttttattgcccattcgttaatggtcgtcatgataccgagtatttcggaagcttatgcactttctcagtatgacatcgtgttaaaaaggctgaagcagtcgattttcattacattaggttacggtatacctgccgtctgggtcatgttccagtttgcgggacctctcacgcatttgttttttcactctcctgaagcgcagtattatttgcagctgttgtggccttactttctctttcatctgtttgtcatgccgctgcaggcgtgcttaatcgggatgggttttgtgaaagaggctttttatcacaatgtatggagccatatcgttgcgctaagtatgatgtatgtactgggatcaatggagaatctgcaaatgctcgggattatccttggaatgaacactggcatgattcttttgacgagcctgcactatgccacgatctgcaaagcattgaaggtatccgtattccttacgggagggaccagaacgccgcgaattgaaggatgatataggaactgcaggggcaagctaattgaaaagcatgaaaggaagattccatgttgacgaagcgcttgcttactatatacattatgttattagggttgattgcatggtttccaggtgcggcacaagctgaggaaaaacagcctgctgttcccgctgtttttcttatgaaaacgatagaaggggaggacatttcgattccgaataaagggcaaaaaacaattctccatttttggacgtcatggtgtccgccctgcaaaaaggagcttccccagtttcaatcgttttatgatgcccatccatctgacagtgtaaagctggtaacggtgaatttagtgaattcggaacaaaatcagcaagtcgttgaagactttattaaagcaaacaagctgacgttcccgattgtccttgactcaaaaggggaattgatgaaggagtatcatatcattacgatcccaacatcatttttgctgaatgaaaagggagaaattgaaaaaacaaaaattggcccgatgacggcggaacaactgaaggaatggacggaagaatagctgagagcatagactctcagcttttttcatatagagaagaagtgaataaacattaatgataattattatcaaaaagaaattaaaataattataattgaaattctcttcgtgcgtgctataataaaggaagacatcaagaaataactgacgataaagctgccttttgggcagcgattttgtttttataagagaaatgaagatgatttacgttctcaattagagaggagaattcgatatgaatgaacaagttatcgttcaacgcgacccgcatgagccattgaaaacagacaagagggaaaaaaactgggcacagcacgcggagcttattgcagcacttgtatcaggcgctcttattttggcaggctggctcttatccggatatcaggtattatccataatacttttcttgctggcttttgtgatcggcggatttgctaaagcaaaggaaggaatcgaagaaacactcgaatccaaaacgctgaatgtagaacttttaatgattttcgctgccgttggttccgccttgatcggatactgggcagagggtgctattttaatatttattttttccttaagcggagctttagaaacatacacgatgaataaaagcagcagagatttaacgtctttaatgcagcttgagcctgaagaagcgacattgatggtcaatggtgaaaccaaaagagttccggtttcagacttgcaggccggtgatatgatcgtgatcaaacctggagaacgcgtagcggcagacggtatcattgaatcgggctcgacaagtcttgacgagtcggctttaacaggtgaatcaatgcctgtagaaaaaaacacaggcgacactgtattcacaggaacggtgaatcgcaatggctccttgactgtccgtgtcacgaaagcaaatgaagattcgttattcagaaaaattatcaaactggttgaatcagcgcaaaatagtgtttcacccgctcaggctttcatcgaacgatttgaaaatgcttatgtgaaaggtgtgctaattgcggtggcgctccttttattcgtcccgcactttgcgctgggctggagctggagtgaaaccttctaccgcgcaatggtgtttatggttgtcgcgtcaccttgtgcgcttgtcgcctctattatgccggcggcgctgtccctgatttcaaatggcgcccgcaacggtatgcttgtgaaaggaagcgtctttcttgaacagctgggctcagtgcaaatgatcgcctttgataaaaccggaactgtaacaaaaggccagcctgccgtagagacgatcagaatagcagaaggattcagtgaagcggaagttcttgaggctgtctatgccatcgaaacgcaatcaagccatccgctcgcccaagccataacggcgtacgctgaaagccgcggcgtgaatcagtccggctacatatctatagaagaaacctcagggtttggcgttatggcagaagtgtcgggtgcgaaatggaaggtcggtaaagcaggttttatcggcgaggaaatggcagcacaatttatgaaacaaacagcatcagatgtcattcaaagcggtcatacaattgtatttgtgaaaaaggatgatcaaatagcaggctgtatcgcactgaaggaccaaatcaggcctgaagcaaaagaggtcatggaagaactgaaccgacttgggattaaaacggccatgctgacaggagatcacgaagacacggctcaagcgattgccaaggaagccggcatgacaactgtcgtggcagaatgcctgcctgaccaaaaagtgaatgaaatcaaacggttaaaagaagaattcggaacgattgcaatggtgggtgacggaatcaatgatgcgccggcactcaaagcggcggatgtcggcattgcgatgggcggcggaacagatgtagcacttgagaccgctgatatggtcctcatgaaaaacgatttgaaaaagctcgtaaacatgtgccgcttgtctcggaaaatgaacaggatcatcaaacaaaatatcgtgttttctctagctgtaatctgcctgctgatttgtgcaaactttttgcaggcgatggaattgccatttggcgtgattggtcatgagggcagcacgattttagtcatactaaacggtttaagactcctaaaataaaaccagcagcctaatcaggctgctggctttttatgtatcaagctttcccttcatttttgtctttatcagatcttttcataactaggatgagagcgaggatgcagcaaaggaaacccgctgcacagcctatgatagagctgtaataataaaagcccaccatcttcatcccgataaaaggagcggaaattcccaaaaccgttaagagcataactgcttttcgtctgaaaaaattcatcagcaaacggaacaaccccctgcgattgaacgttactgtcagtatacaggaagaggagcaggaaataaaatgcattagaaaatgaaggcgtcgtgaaaggcaaacaccggtaaaacctgttacaatggaagacagaacaatgcattgcaaatggcagggaggaacaagaagtgaatagaatacaacgcgtctcttcatggctgaaggaagcggggcatactgccgcatttattcatacgaaagaaaatgttttttacttaaccggtttttacacagagccgcatgaaagattaatggggttatttatttttcaagaagaggagcctttctttgtttgtccaggaatggaagcaggacaggcccgcaacgcaggctggaatcatgaaatcattggctatgcggatcacgaaaatccgtgggagctgatagagaaggctttgaaaaagcgaaatatcagcatacatatgcttgcggtagaaaaggattcaatctcgctgtcacgtgcagaacagctgaagcatgcgacgggcggggctcaatttgtttcagcagaagaaacactcaatcaatttcgactgattaaagatgacaatgagattcgtttgctgaaagaggcggcaaagcttgcagattacggtgttgaagtcggcacagccgctttgcgtgaaggcatcagtgaagtggaagtgctcgctcaaattgagtatgagctgaagaaaaaaggaattcagggcatgtctttctctacaatggttttattcggagaaaaatctggccagcctcatggaaatcctggtacagccacgttgaaaaaaggtgattttgttttatttgatctcggtgttattcttgatggctattgctctgatattacaagaacgtttgcatacaaaaccatcaatccgaagcaggaggccatttacgagactgtgcttcaagcggaaaaagccgcgattgaggcaagcaaacccggtgtgagaatcggagatctggatttaactgcccgcggaatcattgaaaaagcgggatacggtgattattttcctcaccggcttgggcatggactcggaatttctgtccatgagtatccatcaatgagccaggccaacgatacactgctgcaggaaggcatggtctacacgatcgaaccggggatttatgtgcctgagatcggcggcgtgcgcattgaggatgacgttcacgtaacaaaggacggagcagttgctctgacccaatatccaaaggaattaatcatactgccgtaatagaaataaaaaaggactttgttctcgacatcgtccttttttatctgcattaaataaaaaaatcatcaaatgttcgaaagggtttaatttcatgtttttggttgagaggttttacagcaagacagctgccaccgagaacagtgagacataacccaattaaaatgaagaaacccatgtgatcttctcctttcagcttaaaacacaaaaagatatctggtacgtccatatcatattgtatgaaacgcattccagatcaaggggatttagaaagaagggaatctatggctaatattaaagacattgcagaaaaagccggtgtctctgttacaacggtttcccgagtcataaacaatcatccatacgtcagtgaagacaaacgaaaaagagtgtttgaggcaatggaatcattggagtacacgagaaatattcacgctgtacatttgtcgagaggattttcaaacatgattggtgttgtcttgccgacggttaatctgccatattttgcagagctgattgcaggaatagccgacgcagccgcggaatccggggttcacctctctttattccaaacaaactatgaggtacaaaaagaaatctttgcgctgtcccaattaaagcagcgccaggttgacggcctgattttttgctcaaaggcgcttgctgatgagaaactcatggaatgggagggcccgattttgctttgccagaattcagataatgcccgcttcccaaccatcagcattcctcatcgagaagcatttcggaacggcttggactatttaattgccaaagggcacaaaaaaatagccatctgtttggcaagaaaaaaaggcatgaacagtcattttcgaatcaaagcctacaaagaggcattggaagagatcggcgaggcatttcgtgaagactgggtaattgagaaagcgattacaatcaatgatgggaaggcgctttttcataaatggaatacgtggaaggaaaagccgacggctatttttgttgccaatgaccaagtctcagcagggctttttcttgaagcaaagaaccagcgggtgtcagtaccggatgagcttgcaatcttaagcgttgataaccacgaaatcagccaagcgcttgggatcacaacgatcgatattcagacaagggaaatgggaaagcaggcatttgccatactggaaaaaagaattcaaggacagccgattgaaaggaaagttctggattaccgtctcgtcgaaagatcgactgtttagtgaatgcattgaaaaaaggtttgacgtgcattctgttcgttatgtacgatatgaggtattgaatgacaaaggagctgaggatcgtgaatgggtccttcacagtgaaaaaggtactgaataataacgtattaattgcttctcatcataaatacagcgaagtcgttttaatcggaaaaggtattggtttcggaaaaaaacaagatgatgtcattgaagataaaggctacgataaaatgttcattttaaaagacgagaaggaacaaaagcagtttaaaaagctccttgactatgttgatgaaaagctcgttgatatttcaaacgatgtcatctatcacataagcaataggactaatcactcattaaatgaacatattcacattgcgttgacagaccatatcgcatttgcgatcaaaaggcagcagcagggatttgatatgaaaaatccatttctaatggagactcagtcactatatcctgaggagtaccaaattgccaaagaagtcatagatatgatcaatgaaaaagcgggaatctgccttccggaaggggagattggttttatcgctctgcatatccattcagcgttgacaaaccgtccgctgtccgaggtcaatcagcactctcagctcatggcgcagcttgtcgaggtgattgaagactcatttcaaatgaaagtaaataaggaaagtgtcaactatttgcggctgatccgacatatcagatttacaatagaaagaattaaaaaagaagaaccgactaaagaaccagaaaaattaatgttgttattgaaaaatgaatatccgctatgctacaatacagcttggaaattgattaaaatcttgcagcaaacattgaagaaaccagttcatgaggcggaagcggtttacctaacgcttcatctgtaccgattaaccaataaaatttcataaattcagtttatccttataacgtgttactgattcgatcaggcatgagtgattgagggaaaaaaacgggaagttcattctcgttcttttgcgcacccaattttgctcatgcctttttgttgtgtaaaagggcaaatgtaaacggttaaactggaaggcttacgcctgtgaattcgttgtcatgatttttagctgtaaggtcagactagtaaaaagaggaggtcaattcttatgtttaaagcattattcggcgttcttcaaaaaattgggcgtgcgcttatgcttccagttgcgatccttccggctgcggggattttgcttgcgatcgggaatgcgatgcaaaataaggacatgattcaggtcctgcatttcttgagcaatgacaatgttcagcttgtagcaggtgtgatggaaagcgctgggcagattgttttcgataaccttccgcttcttttcgcagtaggtgtagccatcgggcttgccaacggtgatggagttgcagggattgcagcaattatcggttatcttgtaatgaatgtatccatgagtgcggttcttcttgcaaacggaaccattccttcggattcagttgaaagagccaagttctttacggaaaaccatcctgcatatgtaaacatgcttggtatacctaccctggcgacaggggtgttcggcggtattatcgtcggtgtgttagctgcattattgtttaacagattttacacaattgaactgccgcaataccttggtttctttgcgggtaaacgtttcgttccaattgttacgtcaatttctgcactgattctgggtcttattatgttagtgatctggcctccgatccagcatggattgaatgccttttcaacaggattagtggaagcgaatccaacccttgctgcatttatcttcggggtgattgaacgttcgcttatcccattcggattgcaccacattttctattcgccgttctggtatgaattcttcagctataagagtgcagcaggagaaatcatccgcggggatcagcgtatctttatggcgcagattaaagacggcgtacagttaacggcaggtacgttcatgacaggtaaatatccatttatgatgttcggtctgcctgctgcggcgcttgccatttatcatgaagcaaaaccgcaaaacaaaaaactcgttgcaggtattatgggttcagcggccttgacatccttcttaacggggatcacagagccattggaattttctttcttattcgttgctccagtcctgtttgcgattcactgtttgtttgcgggactttcattcatggtcatgcagctgttgaatgttaagattggtatgacattctccggcggtttaattgactacttcctattcggtattttaccgaaccggacggcatggtggcttgtcatccctgtcggcttagggttagcggtcatttactacttcggattccgatttgccatccgcaaatttaatctgaaaacacctggacgcgaggatgctgcggaagaaacagcagcacctgggaaaacaggtgaagcaggggatcttccttatgagattctgcaggcaatgggtgaccaggaaaacatcaaacaccttgatgcttgtatcactcgtctgcgtgtgactgtaaacgatcagaaaaaggttgataaagaccgtctgaaacagcttggcgcttccggagtgctggaagtcggcaacaacattcaggctattttcggaccgcgttctgacgggttaaaaacacaaatgcaagacattattgcgggacgcaagcctagacctgaaccgaaaacatctgctcaagaggaagtaggccagcaggttgaggaagtgattgcagaaccgctgcaaaatgaaatcggcgaggaagttttcgtttctccgattaccggggaaattcacccgattacggatgttcctgaccaagtcttctcaggaaaaatgatgggtgacggttttgcgattctcccttctgaaggaattgtcgtatcaccggttcgcggaaaaattctcaatgtgttcccgacgaaacatgcgatcggcctgcaatccgacggcggaagagaaattttaatccactttggtattgataccgtcagcctgaagggcgaaggatttacgtctttcgtatcagaaggagaccgcgttgagcctggacaaaaacttcttgaagttgatctggatgcagtcaaaccgaatgtcccatctctcatgacaccgattgtatttacaaaccttgctgaaggagaaacagtcagcattaaagcaagcggttcagtcagcagagaacaagaagatattgtgaagattgaaaaataagggtgttagtacgccgtgcttgtcagatgacaagtacggttgtatgatataatattgtgaagtaattaagctttaagttaaaaggagaatgataaaaatggcacaaaaaacatttaaagtaactgcagattctggaatccatgctcgtcctgcgacagttcttgtacaaactgctagcaaatacgacgctgacgttaatttagaatataacggcaaaacagttaaccttaaatctattatgggtgttatgtctttaggtatcgctaaaggcgctgagatcacaatctctgcttccggagctgacgaaaacgatgctcttaacgctttagaagaaacaatgaaaagcgaaggactcggcgagtaatgcaagaattaaaagggattggcgcttcagccggcatcgcgattgcaaaagcataccggcttgaagagccagatttaacggttgaaaagaaaaacatctctgattctgaagcggaagtaagccgttttgatgaagcgattgcacgttcaaaagaagagctcgaaaaaatcaaagagcacgctttgaaagaactgggtcaggataaagctgatattttttctgctcaccttttagttctcagtgaccctgagcttctgaaccctgtgaaagaaaaaatcagcactgattcagtgaacgctgaattcgctttaaaagaaacgtcttctatgttcgttaccatgtttgaatctatggacaacgaatatatgaaagagcgtgcggcagatatccgcgatgtaacaaaacgcgtaaccggccacctgcttggcgtcgaaattccaaacccaagcatgatctcagaagaggttattattgtagctgaagacttaacaccgtctgacacagctcaattaaaccgtgagtttgtaaaaggattcactactgatatcggcggacgcacatctcactctgccatcatggcacgttctcttgagattccagcagttgttggaacgaaagcggctacaggcacgatccaaaacggcgtgactgttatcgttgacggtatcaatggcgatgtcattattgacccatctgcggaaactgtaaaagagtatgaagaaaaacataatgcttatttggctcaaaaagctgagtgggcgaagcttgtcaatgaaccgactgtctcaaaagacggacatcatgtagagcttgcagcgaacatcggtacccctgatgatgtaaaaggtgttcttgaaaacggcggagaagcagttggcctttaccgtacagaattcctttacatgggaagagatcagctgcctacagaagatgagcagtttgatgcttacaaaacggttcttgagcgtatggaaggaaaatcagtcgtcgtgcggacacttgatatcggcggagacaaagagcttccttacctgcagcttcctaaagaaatgaacccgttcctgggatatagagcgattcgtctttgccttgaagagcaagaaatcttcagaacacagcttcgcgcgctgcttcgtgcaagtacatacggaaacttgaaaatcatgttccctatgattgcgacagttaacgaattcaaagaagcaaaagcgatccttcttgaagagaaagaaaagctcgtaaaagcgggacaggctgtatctgacgatattgaagtcggaatgatggttgagattccgtcaactgcagtcatcgctgatcagtttgctaaagaggttgatttcttcagtatcggaacaaacgatttgatccaatacacaatggcagctgaccgtatgaatgaacgtgtatcttacctgtatcagccatacaacccggcaatccttcgcttaattacactggtaattgaagcagcacacaaagaaggaaaatgggttggcatgtgcggagaaatggcaggagacgagattgcgattccgatccttctcggcttaggcttagatgagttctcaatgagcgcaacgtctatccttccggcaagaacacaaatcagcaaattgtctaaacaagaagctgagtcattcaaagagaaaatcttatctatgagcacgacagaagaagttgtcgcgttcgtaaaagaaacattcaagtaatgtacaaaaaccagacggcctccggcctgtctggtttttttcataagtaagggtatagaaggacacaataacatggctaggagggatagtatgtcaaaccaatttaacgcaggagatactgtttatgtgatctacagaaatccgcacgccgccaatgtagcccacataaaggaagccgaaattgtgcaccatccataccatgaaggcgagctttccctgtttatttatgaaacctatcatccgttcgcagaggacgatgctgtgtttgcaagctatgaagaagctaaatcgctttacaaagaactctttgatattgatccgtatgagtaacaaggaaatcattacaactcatatcctttccgcctagtgagaaaagtaacgttagtaaaggaaaaggatgtggcatcatgcagaacccatttgttccgcagcttgtatatatagaaccgagggcgctggaatatccactaggccaagaattacaagataaatttgagaatatgggcattgaaatcagagaaacaacatcccacaatcaggtgcgtaatattcctgggaaaaatcatcttcagcaatatcgcaatgcgaaatcaactttagttatcggtgtccggaaaacattaaagtttgattcatccaaaccctcggccgaatatgccattccgtttgcaacaggctgcatggggcattgtcattactgctacctgcaaacaaccatgggatcaaagccgtatatcagaacttatgtaaacgtcgaagagattttggatcaggcagataagtatatgaaggagcgcgcaccagagttcacaaggttcgaagcatcatgtacgtcagacattgtaggaattgatcatctgacacacacgctgaagcgcgccattgaacattttggccaaagtgatctcggaaagctccgatttgtaacgaaatttcatcatgtcgatcacctattagacgcaaagcataacgggaaaacgagattcagattcagtattaatgccgactatgtgattaaaaactttgagccgggaacttcacctcttgataagcggatagaagcggcagtaaaagttgcaaaagcaggctacccgttaggctttattgttgctccgatatatattcatgaaggctgggaagaaggatacagacatctgtttgaaaagcttgatgctgctttgccgcaggacgttagacatgacataacgtttgaattaattcaacaccgttttacaaaaccggccaaacgagtgatagagaaaaattatccgaagacgaagctcgaattagatgaagaaaagcgccgttataaatggggccgttacgggatcggaaaatatatttatcagaaagatgaagagcatgcacttcgagaagcacttgaatcctatattgatacctttttccctaacgcgaaaattgaatatttcacttaaacgggctgttgtgatcaacagctctctttttataaaaaggatttttccattccatcaaaacgccgtaattcaatgattctttatcctctacataattgctgactacacgaataggtgaacgcccgcaacggaggagaaaggacagcacagggtcgtttttcctgccttccatcacatcttcaacgtactgaacagcgctgatctcgtgtgcgtatttatgatataaaggaatgcggccgccgccgagaaggcgctccagtctcttatcaacagtcagctcatacatcgtattcatcagccattttccgattccaagctttcgataatgaggagaaacagaaatatccactacatataaagtatttccatgaggttcatggtttttaatcgatccgttgtctgttgcttgtgcccatgtatgatcaggagattcaggctcaaattgtacaataagagcagtcatggaaccgataattctgccattgatgagcgcgcataaagcgccttctggaaaggttttgatatagctggcaagctggtcctctgaccacagcaattcctggggaaacggaggagggaaacattctttttgaagagaaatcagcctctcgatgtcagtctcagtgtagtttctgatggtcagagcctcaaattttctgccgtcgtgcacatacatttgttttagtatgatcatcactctccttatgttgtttcattataacgaagattgaattttcagtaaatatattccggttttcttataatttattttttgattattcatttttcaaacgaaagggccgatatagaaattaggaggggattggtttgtttaaaaaacttcacatgaagattgctgtttttgtttcgattatgttaatcgtcacagttgttcttttaatgctgtcttcttatttgacgctaaaaccgatgattacagaggatgggaaaaatacaactcaaaacgtgacgcagtcacttgaacaaaatattgcattgcaattaaagagttatgccatttcgttatcaagattggctaatggggaattaacgcatacatttataacgaaaccaagtaaagaagcttctcggctgtttcacgatgacattaagcaaatcaaagaaaacgatgattatgttgcgatggcttacataggcaccgcaaaaaaagaaatgtttacatatccaaaagcggatttcgctgaggattatgatccaacatcaagaccatggtataagcttgcagctgaaaccccggatcaagttgtttggacggaaccttataaagatgtcgtgacaggagacatgattgttactgcatcgaaagcgatcttagacgggcaaaaagtgataggggttgccagctatgacttgaaactctctgctatccagagtatggtcaataaacaaaaggtgccttacaatggatttgcctttttagctgatacgagcggcaatcttttagcccatccgtcaaatcaaggaaaaaatatatcaaaggatcaaacactgcaaaccatcgcatccgagaaacaagggatacaagatgtgaatggaaaaatggttgtgtaccaaacgattggcgaaacggactggaaggtcggaacgcaatttgataccgatcaattaatgtggatttcagataaaatgaatcgggcaaatctttggatatcattgcttgcgcttatcataacaattattctcagctacttcctggccaaaacgataaccggtccgatacagcagttgatcgcaaaaacgaaagctgtttccgcaggcgatttaacagtgcgcgcggaatcaaaatctaaggatgaagtcggtattttaacaagagatttcaatctgatggttgaaaatatgaaggaaatggttgagcaagtgagactctcttcagggaaagtatctgacacctctgaacaactaacggctgtctctgccgaaacaaatgaaacaagcggacaaattgcaaaagcgattgaagaagtagccgcaggggcatcggaacaggcttctgaagttgaaaccattaatgaaaaatcggaaagcttgtcaacgaaaatcaggcaaatcgctgaggaggcaggcggaattaaagaacgctctaaatcgtccgaggatgcaagctataaaggacttgacgcgctcggccagctgctgatgaaatcaaacgaagccaatatggaaacgaaaaaggttgaaacgatgctgctggatttggaaaatcaaactaagaatattgaagaagtcgttacagcgatttcaaacatatctgatcaaaccaacttgcttgccttaaatgccagtattgaggcagccagagccggagaaagcgggcgcggttttgccgtcgtagccgatgaagtgcggaagttagctgagcaatcagccctttctacaaagcatatcagcgagactgtgaagcttatccagcttgagacaaaagaggcctctcacgcaatggttgaggcaagcagaatgaatgatgaacaaaatagtgccattcacgaaactggagaggtattaaatacgataactgcagaaatgcagtcactggtacaaggtattgatcacatttacgcggaaattcaaagaatgagtgaagaacagcttgcgatatctgaagctattcaaagcatttcagccatatcacaggaatcagctgccgcagcagaggaagtgaacgcatcaaccgatgaacagcttgtcacccttgataaagtcaaacactcaacggaaacactaaaacatgcaagccaagagcttatgaacacaattgcaaaattcacattgtaatccaattacatccccaaacatcatttgttttggggattttttattttataagatgaatagatatggtagtctagaaaatgaaggaaaaatgataaattttaactaaaatctaaacgaaacatctgggaggaatgaccttgaaaaaaacaattggttttatcggtcttggagtaatgggaaagagcatggcatcacatattctgaatgacggccaccctgttttggtgtacacccggacaaaagaaaaagcagaaagcatacttcaaaaaggcgcgatctggaaagatacggtcaaagatctttcgaaagaagcggatgttatcatcacaatggtcggctatcccagtgatgttgaagaagtgtatttcggaagcaatggaattattgaaaacgcaaaagaaggcgcatatcttattgatatgacgacatctaagccttcgcttgcgaagaagattgctgaagcggccaaagaaaaagcattgttcgctttagacgctcctgtttccggtggagacgtcggtgcacaaaacggaacactcgcgattatggtcggtggagaaaaagaagcttttgaagcctgcatgccgattttctctttaatgggagagaatattcagtatcaaggaccggctggaagcggacagcataccaagatgtgcaatcagattgcaattgcagccggtatgatcggtgttgctgaagcgatggcttatgctcaaaaatcaggcctagagccggaaaatgttctgaaaagcatcacaacgggcgcagccggaagctggtcattgtcaaatcttgctccccgtatgctgcaaggcaactttgaaccgggattttatgtgaagcattttattaaggatatgggaattgcactagaggaagcagaattaatgggggaagaaatgccaggcttgtcgctcgcaaaatccttatatgacaagctagctgctcaaggtgaagaaaacagcggaacacagagtatatataagctttgggtgaaataaaaagactgcttgtatcctgcaggcaaccatcaggctgtcgtgaaaatctcgacagcctttttttggactataagtgcgtaaaagagaaaaataccacttgttttaaataattgacaaaaaggagacagtattttactgttgccttaacgaaaaacgaaagggtgaaaataagaacatgattctataattctagctttaagaaagaatcaatagcttaacctatacattcaacatcagtgactatttttctgatgatctgaatggcttatttgttttgtttattgatttattctctgagataggattatggggtaatgttcttattactaaagcggctttggagtgaagtcgatttagcattgcctcctatctcagaaaagtgagtataggaggctttttttgtagattattattgatgggagtattgatatgaagcttgaacagcaagaaataaatattttacattctgattctggtccatatgggatagccatttcacccgaaggaaaggtatggtttactcaacataaagctaacaagatcagctgtcttgataagacgggccaaattcaagagtatattgttccgacacctgatgctggagtcatgtgtttaacggtgtcttcagaaggtgatatttggtttacagaaaatagggctaataagatagggaaactgacagcaaaacggcaatttatagaatatccattgccgcatcaacattcagccccatatgggattacggaaggtccaggcggagatacctggtttactgagatgaatggaaatcgtataggtaaattgacatcagagggcaaaattcatgaatacgaactgcctaatgaaggatcgtacccttcttttattacgttgggttcagatcactcactttggttcactgaaaaccagaataatgctatcggcaaaataactgaatcaggtgagttaacggagtttccaattcctacaccagcagcaggaccagtaggcattacaaaagggcatgatgatgcactttggtttgtagagataatgggtaataagataggtaagattacggtttccggtgaaataactgaatatgatatccctacaccaaatgcacgacctcacgctatcgctgcaggtgtaaaatctgatttatggtttaccgaatggggggaaataaaatcggaaggctgacaagtgatcaaacaattgaggaatatacaatcaacacacctcatgctgagcctcatggaataggatgcgataatgatggcacagtttggtttgcattagaatgtaacaaaatagggaaattaaaattaactaaataatgggaaatgagctcctttgcacctcatgcgaaaccctaagttgctcaacctgactcaaaaatttctcctttattataaaaagtcaaatctatcaatggcataaatctattgcagcagctttgctattgaaggtgaaagaaaaacggatttagtgaacaagttcccctcacagccgggtgaagaagactgccttaacttaaccttgcttggctgggggtctggcagcttttttctgtttctccatacatttagatgaatacaacaaaaaagcttgtagaaaaaacatggttttctctacaagctgaagattacctgtatcgtacagggaattttttttgttattttccgatgaattgttgtgtccagatgcttccagactcaacgtagccaacaccgatgtgagtaaagttagggtttagaatgttttttctgtgtccttcactgttcatccaagcttttactacttcttctggtgtcttttggcccttcgcaatgttttcacctgctgttttgtagctgattccgaaagatttcatcatatcaaacggtgagccgtatgttgggctttggtgatcaaagtagtttttgtccttcatatcctgagattttgcgcgtgcagatttgcttaacgtttcatcaatttgaagcggctttaatccttgtttttgtctttctgcatttgtaagttcaacaacttttttctcatatgcacttacagatgaaggtgcagatgttgttgtgtttgttttttcagcagttgcaggtgctttagaagcagtgttttgatcagcagctgctttttcagtagtcttttgtgcaggttttgccgtttctgtcttttgaacatcctgaactttcacgttagattgcttcgcatgtttttgaagaagctgcttaatctctttttcgtttgcagcgtttaacgttttgatatttgtgttaatatgcagttttttcactgcatcgttaagtgacatgttttgtactgtgttccccgtttttactgtaaccacaggctggcaggagagttctttcgctgatgcttgctgtacgccccgaatgtgaataagccaaccgcagcggcagcagataaaataaatgctttcttcattagttcgtaacctcctagagttgtttgtttctacagaaaaatcataacatagcttttttgtcataaaggttccagcactttcctttgacaaatagagattgtcattttcgtaaagtaaatccgttgaatcactaagaataagggaatcagcggtatatatgattttatcgtaccgttacatatcttccttttttttgaaccgttagttatattttaatgtgtttttatattgacagctttttttactccttttcgctgtaacaactattacaaaggtgttacaattaatctcagtatatgtaaatatattgaatgatttgagaggggtaaccagaagtgactgaaataggacgtgaaccaaagaaaaagagcaaaggaaacagagcaatcagaatgaacctttttttcctagctgtctttgttctattcactgcattaatttttaagctcggggttgttcaaattgttgaaggcgaacagcatgaagaagacgctgagaaatcaaatgcaaaaacagcttactatcctgcgcctcgcgggaagatgtacgacagaaaccagaaagttgctgtcgacaaccagagcgttccagaaattgtgtatgtatcaacatctagcacaaaaacagaagataaaatcaaaacagcgaagcggcttgcttctttcattcatattgatactgaatttttgaaggaaagggatcttcgtgattactggatcgcagctcatccgaaaaaagccgccgctctgcttaaggaatcagaaagcaatctgaaaggagaccaggcttacaagcttcaaatagagcgtgttccggatcaagaattaaaggctattcagcaagatgacgaagaaatggaaactgctgcgatatatacaaggttttcaagcggaaatgcttacgaacctcaaatcgtaaaggcaatgaatccaaataagagcaatagcaatggaaaaaacggagcgctgcttgatgagaagaaaaactcctcgcaaagaccaaaaaatgacttaacatatgatgaaatttccattgtttctgagcatttagaagaacttccgggaatcgatatcgtaaacgattggacacgaaaatatccttatgacaaaaccctttattctgttttcgggggcgtcacgacacctgatcagggcctgctgagcgaccggaaagatttctacttaacaagaggctatgcgaataatgacagggtgggaaaaagttatttagagtatcaatatgaagaatatttaaattcgcataaagaaaaagtggaatacgtagaagataataaaggaaatgtcgtcagccaaaaaaccattgataaaggcagcaggggatacgatcttcagcttgcttttgacatggagcttcaggcaaaggtagaaaagatcattgaagaagaagtaagaaacagccgtgcacgcggaaattacatgcttgacagagcctttgccgtgatgatggacccgaataacggcgatattttatcgatggcagggaaaaagatagatttaaaaaccaacaaaattgaagattatgcgataggggcatttaccacccaatatgaaatgggatcagcagtaaagggggccaccgtgctagccggctatcaggacgggatcccgcattataaatattttgttgatacacctctttatttagcaggatacggtaacaaaccgaagaaatcctacatgaacatgggaaccatcaatgaattaaccgctctgcaaaaaagttcaaacgtatatatgtttaatgttgccatgcacattgccggtgtcacatacaagccgtatggacctcttcctgctgaccagaaggatttaaacaaaatgagaaattactacagccaatttggcctgggagtaaagacaggtattgatcttccgcaggaatcagccggaatgcaaactacacctgatgcggtaggggggttaattttagacttggccattggacaatacgatacatatacaccgcttcaaatggcacagtacatctcatcaattgccaatgggggctaccgtgttcagccaagaattgttacaagtatccatgagcccagcaaaaaagaaggccttgggaagaccattgaacaaagaaagccaaacattctcaacaaaattaacaactcagaaagtgacattcagcaggtgaagaccggaatgaagctagttaccacttcagggacagcaaaaaatacgtttacagaagatgtatcagggaaaacgggaacagcggaaacattttactacggcacgaatcgcaactggtggggggaaaaaacatacaatctgacttttgtcggctattacccatcgaaaaatccaaaagtggcttttagtgttgttgttccatcagtaaatgatgatgataagatcaataaaattattgccaaaagagctatacacgcctacgcagagctcgaaaaaaaacacagtaaaaaataaaaaacagggtgcacaacgaaaagattgtgtgccctttcttttattcaaaaattgacgttcaccataagaatagaaggagaatactcattttctagcgaatcatactaggtaaaagtcaatctgtatatgtcgaaacacgatgatcatgcaaaggagggattctgtggaacaggatacgcagcatgttaaaccacttcaaacaaaaaccgatattcatgcagtcttggcctctaatggacgcatcatttatatatctgccaactccaaactgcatttgggctatctccaaggagagatgatcggatcattcctcaaaacgtttctgcatgaggaagaccaatttttggttgaaagctatttttataatgaacatcatctgatgccgtgcacctttcgttttattaaaaaagatcatacgattgtgtgggtggaggctgcggtagaaattgttacgacaagagctgagcggacagaacgggaaatcattttgaaaatgaaggttcttgaagaagaaacaggccatcaatccctaaactgcgaaaaacatgaaatcgaacctgcaagcccggaatcgactacatatataacggatgattatgaacggttggttgaaaatctcccgagtccgctatgcatcagtgtcaaaggcaagatcgtctatgtaaacagcgcgatgctttcaatgctgggagcaaaaagcaaggatgctattattggaaaatggtcctatgaatttattgaagaagaatatcatgatatcgtgaaaaacaggattatacgaatgcaaaaaggaatggaagtcggaatgattgaacagacgtggaaaaggcttgatggcacacctgttcatttagaagtgaaagcatccccgaccgtctacaaaaaccagcaggctgagctgctgctgctgatcgatatctcttcaaggaaaaaattccaaaccatcctgcaaaaaagccgtgaacgatatcagctgctgattcaaaattccattgataccattgcggtgattcacaatggaaaatgggtgtttatgaatgaatcgggaatttccctgtttgaagcggctacctatgaggacttaattggcaaaaacatatacgatcagctgcatccttgcgatcacgaggatgtaaaagagagaatccaaaatatcgccgagcaaaaaacagaatctgaaattgtcaagcaatcctggttcacctttcagaacagggtcatctatacggagatggtctgcattccgacgaccttttttggtgaagcggccgtccaggtcattcttcgggacatttcagagagaaaacaaacagaagaattgatgctgaaatcggaaaaattatcaatcgcagggcagctcgcggcgggaatcgcccatgagatccgcaaccctcttacagcgatcaaaggatttttacagctgatgaaaccgacaatggaaggcaacgaacattactttgatattgtgttttctgaactcagccgtatcgaattaatactcagtgaactgctcatgctggcgaaacctcagcaaaatgctgtcaaagaatatttgaacttgaaaaaattaattggtgaggtttcagccctgttagaaacgcaggcgaatttaaatggcatttttatcagaacaagttatgaaaaagacagcatttatataaacggggatcaaaaccaattaaagcaggtattcattaatttaatcaaaaatgcagttgaatcaatgcctgatgggggaacagtagacataatcataaccgaagatgagcattctgttcatgttactgtcaaagacgaaggggaaggtatacctgaaaaggtactaaaccggattggagagccatttttaacaacaaaagaaaaaggtacggggcttggattaatggtgacatttaatatcattgaaaaccatcagggagttatacatgtggacagccatcctgaaaaaggcacagcgtttaaaatttcatttccaaaaaaataaaacaacggcttaaacgccgttgtttatcgtctgcatggcttcacgtttttttaatacaaataattctaaacggtccaggccttctctcagcgtgtccagcgagtacgcaaaagacaatcttacatatccttcaccatatgttgagaacgagctgcccggcacgagtgccacaccagcgtcttccaaaagagccatactaaaatcaaatgaagtcattccaaatgatttaatagaagggaagatataaaacgcaccggacggtttaactacgtcaagtcccatggaaacaagacggtcataaacatagtccagacgttttttgtattgttctctcataatcaatgcgtcgtcaaagccgtttgtgacagcttcaagcgcggctttttgagaaatggatgaggcgcacgacacattgtattgatgaacctttaaaatgtgctttgcaatgtctttcggtgcgaataaaaatccaattctccaaccggtcatgctgtgtgattttgacaagccgttaatgacaattgtttgatcccgcaaatggtttgcgatggagtaatgcggtctgtcatatgttaattcactgtatatttcatcagacaatacgaagacatttctgccttttaaaagggctgcgatgcttttcagttcttcttcagataaagtcacgccggtaggatttgacggataaggaagcacgacacacttggtgttgggtgtcagagcatcttcaatcagccgggcggtaagcttaaagccgtgtgacgtagtatcaacaatgacaggcttggccccgcacaaattgataataggttcatagcccggataaataggccctggcataatgacttcatcaccgggagataaaatcgtccggaatgcagcatcaatggcttggcttgcgcctgttgtgatgataatttcagattcagcatcatagttgaaatccgcttttttcttcatataaagctgcacagcttgtctcagctccaggtagccggcattcggagtatatgacgtcacgttttcatcaatggctttttttgcggcagctttcacatgatgcggtgtgaaaaaatcaggctggccgattgtaagtgaaatgacgtcttcgtgttgggctacaagattcgagaatttgcgtattcctgaaatttcgatctctcttgctttcggattcagcaaatgttccataattcatcaccttaacaaatataatgagtttatcctattttaccactagctgatcatttgtcacctttttaactgatatatttcgattgtatgcgccttttttctaaacatacctttcttttcagaaaaaaagaagacaaccagcgatttgattgtctttattgtatcatgttctattattgtttatatgtgccaatttcattaatagccataatcaaaatgaaggtcttcgtgccaaatcagatacggaggatgctcttcttgaaggtcagctgattctttcttcatattcaggtaagtttcttcactgatatcctctaaaacagtcatttcgttttctttaaatattactaaggtacccattatttacacccttctttggaaaaatccttgactattttatcactgttagttggaaagtcaatggttattaggaaaaaagtttcttttttgaggaacgcggcttgttgccttcggaattcgattttgaagagctgccattcactttttacaaattacgccgatatatacagtacaatactgaatgcgaatagcgagggattgaattgtcgttacaacaatacgaaattttattggattctggtacaaatgaattagaaattgtgaagtttggcgtgggtgaaaatgctttcggaattaacgtcatgaaggtaagagaaattattcagcctgtcgaggtgacatcagtgcctcactcccatcagcatgtagaaggaatgattaaactcagaggagaaatcctccctgtgatcagtctcttctcattttttggagtagagcctgaaggatcaaaagatgagaaatatatcgtgactgaatttaataaacggaaaattgtttttcatgtcggctctgtttctcaaattcacagagtatcctgggaagcgattgaaaagccgacatcgttaaatcaaggaatggagcggcaccttaccgggattattaagctcgaagacctgatgatctttttgcctgactatgaaaaaattatttatgacattgaatcagattcaggtgttgacacgtataatatgcacaccgagggcttcgatgaaagaagaactgataaaaagctaatcattgtagaggactcaccgcttttgatgcgcctcttgcaggatgaattaaaagaagcagggtacaacaatatcgcttcgtttgaaaatggaaaagaggcatatgaatacattatgaaccttgctgaaaacgaaactgatttatcagaacagattgatatgatcatcactgatattgaaatgccaaaaatggacggacacaggctcacaaagctgctgaaggaaaatccgaaaagctcagatgtgccggttatgattttctcatcgttaattacggatgatctgcgtcaccgcggcgaagttgtaggcgcagatgagcaaatcagcaagcctgagatcagtgatttgattaaaaaagtggatacgtatgttattgaataaataaaaacagccgttgccagaaagaggcacggctgtttttattttaaaagtaactctcgccaagttttttaaagaccggtttatggtaagctggctgctggcgatttggcactagcggcttttctttcatgccgacatattcttgcaataggtgtttcgcttttgttaaagacatttgagctttaggatttcggtacgattgattaagtgtacctaaatgcggaagatgttcgaagtcttctttagttggaggcatgtgaaaatagtagtctccgattgagataagcacgtccgattgctgttggctgaaccttggattttttgaaaaatgaagccctattttctttcctttaccttctttgacaagcttttgcaaagcccgttttttcagcagatataggtatttagggttgggggcggtttttgcatggcggttcacagtgtaaactgcttttgaaagattttctacggttggctgcagatctttcgcatatgcatggtcgtccattatttctctcctttgctcttatcaatttctatatgtttagattatacttttttaaagttgaaatgcaaatattgaatgtaaaaatgcgcttttttctaagaaaaaaagcgcatttttaacctgcattatacagatcttgccttctttttcggctgttcttgaaatgcttcctgaacatttacttccacagcctgagcactgtattttggcagtgcaataaaataaaaaataaaaacgagcaggataataacacccatgccgtaataaagataatcaatgtttgaaacaaacttagggaataacagtgcgactaagccaagtgtcaaagactgtgcaaacatcataaaagggtcctgcatgccgcttacacgtcccatcagttttggatgaacaattttgggcatccaccctccgattgcaatgttgatcggtccgatgcacattcccagtgcaaaagctgccgcgtaatacacccataaaatattggtgtagccgaggacgaagatcagcaaacctgcaatgaaaatcggtatcgacattaaaaagtgcggcttcacttttttagagatgatcgtgccgattacgctgcccgccagcagcccaaacccgagtgcgatcgtaaatacagacgtatgccactcataacggtcaggcgccaatccatatttcattgtaaacatcggcaatacggcgaatcctccattgacaaatccaaaaatgaagaagccaaaaataagagatgccagcaatttgttttttaaaatatagaggatgccttctctaaagtcatttattgaatccttaacagaagtctttctccagctgaatgcaccgtttggctgtcgggcttcttttggaatcctgcagctgcggatcagcagcccggaaatgataaagctgacaaaatcaagaataatggcgccttcaataccgatggtgttgtacataaacgcgcctataccgactccaaacaccataaaaatgctaaaaagcatctgattaagccctgccgctttcgcataatgctccttcggcagaatggcttgtaccaaactgttttctgccggaaagaaaaactttgttacagcgcttctgataaataagatacaaaaaacaagaggaatattgccggtaaataaagtgaaaaaaagcacgacagtcaggcctgctctgatccaatcacaattttctgccaccttttttctgtcaaaccggtccgcgacgactcccacgatcagaaatacaaatatggtcggaagagaatacatcagctccgccaaggtcgtatatgaaggctggctgctgaatcggtccagcaaaaaaaaagcaaaggccatgttgcctactgtcgtgcccatttgagaagcgagtgctgcgaaaaatagacgaacaaaattacgatttttaaatatatccataaaaacgctccttaccctaaaggtcccactttatcatattataaaccgcctgtttttgaaacaaataagaaaacattaccggttaatcgtgactcttgttccgtttggcacaattgaagcaagttcgatcacgtctttgttatgcatgcgaatgcagcctttagaaacagccttaccaatcgaagcgggattattcgtcccatgtattccgtagtgctgctttgaaaggctcagccaataagcgccaaatgggccgccgggattgcgctggcggttaataatgtaaaactcgccagtaggcgtttgcgttagtattttaccaacggcgatgggataggttttcattacccgattatttaggaacagcgtaagggtcttcgctccgattgagactgcgatatgatacggaattgtataagggtccggcagtccggggatgactatggactgtcccgcagtgagccctgcctgcagtgacggattagcctggagtaatgcagccgtgctgattctgaaatcagccgcgatgctgttcagtgtatcaccttgcttcacctggtacgtaagcagtttcctcatcctccttttttacttataagtattgatgaggagcccatcctgctacattaatttgtgctttttaaggtgaagacagtgatttcaggcttggccagaaaccgcaaaggcagcctggtcatcccgaggcctcggtttacgtaaatatgagtgctgcccatttgatacattccctctgtgtagacttttccatatggaggcgtaataatcggtccgtaaaaaggcagctgaatctggccgccgtgtgtatgaccggaaagctgaaggttcacgggataatctgttgttttcaaggctgcatcaggttcatggacgagaagaatggaaaaaagcctgtcgctcagccttgaaagggtgccttcataatctgggtttcccagcattaagtcatcaagcgaagcaatctcgattttgctgccatctgcgagtgacaatgtttgatagccattgcgatataccgtgaaacctccggccgtcatcaggcttttgtaaacggcagttccatagcctccgtgatcatgattgccgtaaatacaaagcttgccgaatggagcattaagctttctcaataatggaatgactgcctggtggtgctggtacgtatcaggattatcaataatatcacctgtaaaaacaatgagatcaggtttagattcattaattgtaagaatgacagtttttaaatcttcgagagtaaagtaatcactcaagtgtgcatcgctgaactgcacgattttaaaaccgtcaaatccgtgcgggatgagagagctttttattgtgtgttcggttgtctcgatcatatgcggctcgagatacctggcatagccatatcccccgccggccgttaaagccccggcagcaagagcgccgaacattccttttagaaattgtcttctggacatctttttcatttcaaaccaacctttaatagagtttttctattatatcatctgtatctgataaaaatctcatatgagcatgtgctgacagaggcagggatataatgatagaatattattgaatgaatactcattcacaattggagggataaacatggaaaaaaaggctgtaattattaccggcgggtcaagcggcatgggaaaagcgatggcaaaaaaacaggctgaattagggtggcacgttatggtgacagggaggaaccatgaggcacttgaggaaacaaaaaaagaaattcagacctttgagggacaggtcgcttgttttcaaatggatgtccgttccgattccgccgcttcagacatgattaaagaagcgataaaagcctttggccggcttgacgcgctgattaacaacgcagccggaaactttatttgtccggcagaaaagctgacgcccaatggatggaaagccgttattgagattgttttaaacggcacatttttttgcagccaggcagcggcaaggcattggattgaccagaagcagcagggtgtcattttaaatatggcagccacgtacgcttggggagcgggagcgggggtcgttcattccgctgcagccaaagcgggggtattgtcattgacaagaacgctggccgttgaatgggggagcaaatacggcattcgcacaaacgcgatagcccccggaccgattgaacgaacaggtggtgcggagaagctatttgaatcggaaaaagcgatggcccgcacgatgaacagtgtgccgctcggccgattgggcacaccggaggaaatcgccgctttggcagcgtttttgctttctgatgaagcatcctatataaacggggattgtatcacaatggacggagggcaatggctgaatccttatccgttttaaagaatattaatctttggattcaatgtggtataatcagacaaagatagagaagcaggtgataacatgttggatccacttgatattttaacgaacattgatgatgtccttccatattaccaggcgattttcagtgccgaggaacagaaggttgtcggatatgaggtgcttggacgaattttggcagattcagaaatccaaagtctcggacccttctttttagatgcagggatacccgaagaatataaattagaggttgataacagaattatccgccaggctcttgaccgctttttagaggcggattctgatctgctgatttttatgaatcaggatgccaatctgctgatgttggatcatggtgaaagctttctggagcttctgaaagaatatgaagcgaagggaatcgaactccaccgttttgttcttgaaattacagagcacaattttgaaggggatattgagcagctctaccatatgcttgcatactatcgtacatacggaattaaaatcgcagttgacaacatcggaaaagaaagcagcaacttggaccgaatcgcgctgctctcaccagatctgttaaaaatcgatttgcaggcgctgaaagtgtcacagccgtcaccgtcatatgagcatgtgctgtacagcatatctttattagcaagaaaaatcggtgcggcgctgctgtatgaagacattgaggcgaacttccagcttcagtacgcctggagaaacggaggccgctattttcagggctattacttagtgtctccatctgaaacgtttctagagagagatgtattgaaacaaagacttaaaactgaatttcaccaatttatcacacatgagaaaaagaaactggagaccgtctatgagcactctgaacagttttacaaacgagtgcatcaggctgtgacctctttgagaaaaaacaatctgtcttctgatgatgactttattaaaaagctggcggaagagctgacagattgcagcttcaggatttacatgtgtgatgaagaaggcgatcagctgacgggaaatgtgtttaagcaagacggagaatggatttatcagccggaatatgctgaaaagaactggagctggcgcccttattttctggagaacattatgagaatgagaaatctcagaaaaggttttttcagtgatctgtacagtgatttggaaacaggtgaaatgatcagaacgttttcatatccgatggatgatcagatgtatttatttatagacttgccttattcttatttatatgagcaggacggactgatttaacggctgaaaggccgtttttttatgaaatgaaaaaaatatcaaaaaacgattgacattgatactgagaatcattatcatttaattatagagagaagctactctctgttccccaacccctctatcagatcaagatccgaaaaaacttggcgctacccccgccaagttttttatttgtcaaagcataggacaatccaatgaaacaataaacctaactagtggtaaatgtttaacacggggagaaacattcagtgctgaacacccctgacactgctgcacgggtaaggaggaaaattcgttctgaaatgattatttatttcagttccgttgtttacctctatccagcatgactcccattgattatggccacgcgggacttcaccataaaattcaaaagaaggttttgacaaaattgcaaaaaggcattcttaatgctgccaaagattcgaaaaaaattataattgtgtgcatgacattcaaaaaaagcctcaaactaaagaaaaatagtttttttcactttttttctttgcttaaattcagcagtgaaaatgccatcctgtccgactttatggtatgatgctcaatagaacttgtattataataaatacttgttgatttgaagttgctttttgaaaggagtctttttttagaatgtcacaattaatgggtatcatcacacggctgcaaagtctgcaagaaacagcggaagcggctaacgagccaatgcagcgttatttcgaagtgaatggtgagaaaatatgcagtgttaaatatttcgaaaaaaatcaaacgtttgaactgacggttttccaaaaaggtgaaaaacctaacacatatccgtttgataatatcgacatggtttccatcgaaatctttgaacttcttcagtaagattcctgaaatagggggaacaagcttccgcctttgcaaaagtaatcgaaataaacggtaaggaacatacttgtttcatggttgtaaatccttgaaaaggagtgtcgtgatggctgattcttttctgttttataatctttcagaagcacagatgacctttcaagatgtgatggaacggcttaaagcctttgttcaaaaggacccccgttcttcttatgtgttatcgatcggaaccgattcacaggtttaccgcgattacacaaagtttattaccgcattgcatttgcatcgtacaggcaagggagcttggggctgcttgaaaaatcatacagtcgacagacccatacatagccttcgggagaagatttcgttagaaacggcgtacagccaagaaacggccgctcatattcttgatggacacttaatggatattaccgatctgctcctgccctttaccggtgagggggcggatcttacctttgaagttcacttggatattgggaaaaaagggcttacaaaagatctgatccaagaaatgactggacgtattacctccatggggattgaggccaaaataaagccggattcatacactgccttcagctatgcaaatcgtttcacaaaataatttggctgaaaaagccaaggtaaatgtcgaattatgcggttgacgtttgttatctgattacttattctagcggtagagctgaaagtaagttgtcttgctttcagaggtattcagtataaaacagggggcctgattgcgaatgagtcttatcggtgaacgatttacagaagaagaacaaaaacttctgctgaatatcctgatcaaccatgagtatgccatcgagctattaagcagtgagatcaacgatatagagacagggaccaaaaacgttgacggaaccacctacaaaaaacttgtaacgctatacgaccgatttcgatttgaaaattaatgggacaccctataattgatactccacaaagagtatcttttttattgaaaggaaacttttcgacaaatactgataaagtttatattattgcaatatagggaatgtattgatgatgaaaatgaaaaggggtcgaaaacatgataagcttacaatcagatcaacttcttgaggcaacagtcggacaatttatgattgaggcggacaaagtagcgcacgtgcaagtcggaaataaccttgagcacgcattattagtattgacaaaaaccggatacacagccatcccggttctggatccttcctatcgtttacatggcttaatcgggacaaatatgatcatgaacagtatttttggacttgagcgaattgagtttgaaaagcttgaccaaatcactgttgaggaagtcatgctgaccgacattccgcgccttcatatcaatgatccgattatgaagggattcggcatggtcattaataacggatttgtctgtgttgaaaatgacgagcaggtatttgaagggatttttacgagaagagtcgttttaaaggaattgaataagcatatacgctcgttgaataagtaggctgtacggcctatttttattatatagccagagcgaaaaaaagaaagcgcatacataatttaaacgagaatagggcttgaataagaaactaagattttattagaatgggagataagaaaaacttattgataacaaaaaggaggacgacatgcagcttcaagagcttcatatgctcgtagttttagctgaggaattaaatatgagaaaggcggcagaacggctttttgtatctcagccggctttatctcagcgcttacaaaccattgaaaaggcgtggggaacaaaaatctttttaagatcacaaaaaggattaacggtaacgcccgccggtgagaaaatcattcagtttgcgaatgatgtgacattagagcaggaaagaataagagaaaatattgacgagcttgaaggtgaaattcacggcacattgaagcttgccgtcgcctccataatcggtcagcattggctccctaaagtcctgaagacgtatgtggaaaagtatccgaatgcaaagatctcgctcataaccgggtggagcagcgaaatgctgaaaagcttgtatgaggatcaggttcatatcggcattataagaggcaaccctgagtggaaggggcgcaaagattacttaatgacagatcatctgtatttagtggatactgaaatttcctgcatcgaagatattgcccatacagaacggccgtttatccagtttaaaagtgacagcacttattttcaggaaattcagcactggtggcatcaaaaatttaaaacgtcgccgaaacagacgatattggttgatcagattgaaacgtgcaaacagatggcgctgcacggaatcggttatgctattttgccgtctgttacccttcaaaatgaagataaagtgaataaaatgcctcttttagacatgaaagggcatccgatcggtcgggatacatggttattaggctatgagcctgcctttgaactgaaacaagttcaagcttttgtacaagtgataaaggatatgctggatcaggaaaatccattttaaagacagcgaggtgctgtctttttttatttatctgttgacaatgaaaatcattatcatttaaagtgatacatatgatattgaaaatcattatcaattaatggggtgataacatggctaaagccttgattacatatgccagcatgtcaggaaatacagaagacattgccttcataataaaagatacgcttcaggaatatgcgttggatatcgattgtgtcgagatagacgatgcggatgcgtcttgtttaacctcctatgattatgtactgattggcacctatacgtggggggacggcgatttgccctacgaagcggaggattttttcgaagaggtcaaacagcttcagcttaatggtttaaaaacagcctgcttcgggtctggcgattattcttatccaaagttttgcgaagcggtgaatttgttcaatgccatgctgcaagaggcgggagctgctgtttaccaggaaacactaaaaattgaattagcgcctgaaacagatgaagatgtggaaagctgccgagcgtttgcgagaggttttcttgcatgggcagattatatgaacaaggaaaaaagccatgtttcataaaggagcaactgctgttacggcatcggcgttttctggatattttgtggcggtacaaagagaaggcatttttcattattctttggagcagggctggagaaagctttttcgtttgaaaagtaagatacactgtatcagctacatagggccttacttatttggcgttggtgaaaagggaacagtcattcgttcggctgatgaagggaaaacctggacgatgtcgagctttccgacaaatgcaacagtgtgggcgattaccggcagaaacaacgggtttgtctgcgcccacggtaagcattgtatttatgtatcggatgattttggtgtctcatggcgcgtagccaaaccttttgccgaatttcataatccccctgttatccggtcgctatgtcttcacgggggcaatctttttattggcacgcaaatacacgaatattttggcggcatttgggcttacgacattaagcgtgacaatgtccaaattgtcaaaaaagaaaaaaaccggatgacggcatccatgctcgtgttcaatgaaaattggctggtggcggcgatgggttctgtgaaaggaaagcacggtgctgtcactgtacggaatcttttgaatggtgaagaattcatcattcaatccagcatgatcagaatagaagaatcatttcttgatctttcagaggatgatggcattatatatgtcactacaacacaagatgaaaatggtttttcaagaatttaccaggttgatctcgaagcccgatcgttaaaatggttcgataccattaaggggcatggatggagagtggccaatcagaaagagaatttcttttgcgcaggcttgtatgaatgtaaatttgtccagccgtacgaagtttcagcaatgattcattagaggaggaacaaggaattggcgaagattttgctcgtttatgcaacaatgtcaggcaacactgaagcaatggcagatttgattgaaaaggggcttcaggaggcggaagcagaagtagaccgtttcgaagcaatggatattgatgatgcccagctgtttaccgattatgaccatatcataatgggaacctacacatggggagacggagatctgcctgatgaatttttagatctggctgaagacatgggggagattgatttttccggaaaaacttgcgctgtattcggttccggtgatacagcatatgaatttttctgcagagcggttgatacgctagaggcaaaaataaaagaacgcggtggagacattgtgctgccttcggtaaaaatcgaaaataatccagaaggtgaagaagaggaagaattaataaacttcgggagacaattcgcaaagaaaagcgggtgcgctgtctgatcactaactgggaactgctaaaacggctgttcctttttttcttgtctttgtatctttcctttgatacagtaatgaggtagaaaatcaggaggaggactatacatatgaaaatgatggacgcaaatgaaattatttcatttattcaaaatagtacaaaatctacacctgtaaaggtttacgtgaaaggtgagctggaaggaatcaatttcggcgaatctgcgaaagcttttatcaacggaaacactggtgtcgttttcggtgagtggagcgaaatccaaacagcaatcgaagaaaaccaaagcaaaatcgaagactatgtggttgaaaatgaccgccgcaattctgcgatcccaatgcttgatcttaaaaacatcaaagcgcgtatcgaaccgggcgcgatcatccgcgaccaagttgaaattggtgataacgcagtcatcatgatgggtgcttctattaatatcggttcagtcatcggcgaaggcacaatgattgatatgaacgttgtgcttggcggacgagctactgtcggaaaaaactgccatatcggcgcgggttctgtacttgcgggcgttattgagccgccatccgctaaaccggttgtgattgaagacgacgtcgtaatcggcgcaaatgctgttgtgcttgaaggcgtaacagtaggtaaaggagctgttgttgctgcgggagcgatcgtggtaaacgacgttgagccatacactgtcgttgcaggcacaccagctaaaaaaatcaaagacattgatgaaaaaacaaaaggcaaaactgaaatcaagcaggaattacgccagctgtaaggaaaagtttgataaaaaaggcgtggataatatatccacgccttattcgtataggcaggaggaatagaaatgaagaaagaggagctcatcgcaattcgcagagatctgcatcgtataccggagcttggatttcaggagttcaaaacccagcagtatttattaaatgtcttggaacaatatccgcaagacagaattgaaattgagaaatggcgaacagggctttttgtaaaagtgaacgggacggcgccggaaaaaatgctggcgtacagagcggatatcgatgcgctttctatagaagagcaaaccggtcttccattcgcatcagagcatcacggcaacatgcacgcctgcggtcacgatttgcatatgacgattgcactcggcattattgatcattttgttcaccacccagtcaaacatgatttgctttttctgtttcagccggcagaggaagggcctggcggtgcggaaccaatgcttgagagcgatgtattaaaaaagtggcagcctgatttcatcactgcgcttcatattgctccagagcttccggtaggcaccattgcgacaaaaagcggccttctatttgcgaatacatcagagctagtcatcgatctggaaggcagagggggacatgcggcatatccgcatttggctgaggatatggttgtagcggcaagtacacttgtcactcagctgcaaacgattatctctagaaacacagatccgctagacagtgctgttattacagttggtaccattaccggaggctcggcacaaaatatcattgcggaaacggcccacctggaaggcacaatccgcacgctttctgaaaaatcgatgaaacaggtaaaggaacggattgaagatgtggtgaaaggaatcgaaatcggattccgctgcaaaggaaaagtgacatatccgtctgtctatcaccaagtttacaatacgagcggattaacagaagaatttatgtcttttgttgctgaacatcaactggcgacagtaattgaagcaaaagaagcaatgactggggaggattttggctatatgctgaaaaaatatcccggcttcatgttctggctcggcgctgattctgaacatgggcttcatcacgctaagctgaatcccgatgaaaatgcgatagaaacagcggttaatgtcatgacaggttatttttctgtttatgccaattaagtacaaatgaaagaataaaattccataaaatgagcactctagtaaacggaggtgttcaaaaatggctaaaaaaattggaattgaacaatcgttatcagatgtagaagctgctttaaaagaaaaaggatatgacgttgtaatgatgaaaagccctgctgacgctcaaggctgtgactgctgtgtcgtaacaggtcttgataataatgtgcaagggatagccgatacggtaacacaagcacctgtcattacagcttccgggatgacggctgaagaaatttgcagcgaagttgaaagcagaattcagtaataaaaaaaccgaagcaaaaagcttcggttcttttatttattctgtttctttagggaaagcgcggtcgaacgcgttctttatttcttttctcaacactcgttcgactcgccactgttccatattttctgttttggcaatgaccctgatcacaatttcagaagtccccagttcttgaatcccgatgacatttgggccttcttttatttgtggaagagccgctgccgtctcatcacaaacctgctgtaaaatatgaatcatttcatcaatgtttctttcagccggcactttaatatcaacaagagcctgcatggtaccacgagaatgattactcacgtttgtgatgtttctgttggggatgtaatgcaatgttccgtcaaagctgcggatttgagttgttcttaagccaacctgctcgacaattccgtcaaaggtggaaacggtaatatagtctccgacatccaattgtttctcaagcaaaataaaaaaacctgtcacgatgtcactgacaagcccttgggcgccaaatccgacagccaggccgacgattcctgcccccgctaaaagagcgcttggatcataatgaaacaaatctagaaccatgacgaagaatataaaaatcaaagtataagcaaatatgttaagagtcaggcttcggagcgtatgtgcacgtcctatagacaagctattctgctcctcgaattttgcaaacagatgtttaatgattttcatgcctaatgatcgaacgataaaatagagcaatatcataatggcgagtttaatgagcagaacaccggcatttgtaatcagtcccgcccaatcatattgtttaataaagtccatgttgagctccttttctaattgatggctgcacattgaggctagttaccctgtacatgaccatgttaaacgttttattcaaaaatgtcgaagccaaagacatgcatgatttgttaaaaattgactcaggaaatctgcttttatataatggcattgcaatataactaaaaatggttaataaccctttattttcaagctatttcgacttttaagccaaacaataaattggagggatacatatggcagaacgtatggtaggtaaacaagctcctcgttttgaaatggaagcagtccttgcaagcaaagaattcggcaaagtaagtcttgaggaaaacatgaaaaacgacaaatggacagtgctgttcttctatccaatggactttacttttgtttgtccgacagaaattacagcaatgtccgaccgctatgacgagttcgaagatcttgatgcagaagtcatcggggtttcaactgataccatccatactcatttagcttggatcaatacagaccgcaaagaaaacggtcttggccagctgaaatacccgcttgctgctgatacaaaccatgaggtatcccgggaatatggcgttttaatcgaagaagaaggtgtggctttgcgcggattgtttattattaatcctgaaggggagctccaataccaaactgttttccataacaacattggacgtgatgttgatgaaacgcttcgtgttctccaggcgctgcaaactggcggactctgtccggctaactggaaaccaggccaaaaaacactttaattctttccaagaacgaaaagcggtctagcatattcgttaggcctttctgttaaataggagggaaaagcaatgaaattacgtcagcccatgccggaattgacgggagaaaaagcttggttaaatggtgaagtgacgagagagcaattgattggggaaaagccgacgcttattcatttctggtccatcagctgccacttgtgcaaagaagcgatgccgcaagtgaatgaatttcgtgataaatataaagatcagctgaatgttgtagctgtgcatatgcctcgttccgaagatgatcttgaccttggtaaaattaaagaaacagccgctgaacacgatatcactcagccgatttttgttgacagtgaccatgctttaaccgatgcatttgaaaatgaatacgtacctgcgtattatgtgtttgataaaacaggacagctccgtcacttccaagccggcgggagcggtatgaaaatgcttgaaaaacgtgtgaaccgcgttctggctgaaacggaataggtatctgactaaatagtatttcctaaaaacctgatcacatcaggttttttatttgtgcaaaaagcaatggaagaagagtaagaagcttatttttccaaatttgggtataggaattgatgatttgtttgattgatacgctaaaaaacacagctaatttttgatgtttttcctcaattttagataaatctcatatctcgtaactcgaaaattgtagatattacactaaatttctttaaagaagtaagtaaaatatatattttcaacattataccaaataaactagaaagacccttgaccccttgagaacaaaggactcttttgaaaaataaaactttttcagaaaataaggaatttttcatagagtaaatataatagtaaaatgctaaaataatagttgataaaattacttttgtaatctaatatcttaattaaagatgttaattttgatagggggtacattgaggaatgtttaatgaaagagaagctttgcgcttgcggttagaacaattaaatgaagctgaagtgaaagtcattcgtgaatatcaaattgaacgtgataaaatatacgcaaaattaagagagctggacagaaatggaagcccttccgaaatcaaaaaggatttccgttctgaaaaaaaacctgactctctgccggttctcgctgagcttgcggctcaggaaatcagaagctatcagccgcaatcacagcagcagtctgttcagcctcagcttcaatctatttcctctcttcctgccggtataccagacggaacaacacgaagaagaagaggaacggcaagaccgggatcaaaagcagctaagctgcgtgaagctgctattaaaacattaaaacgccacaacgcggcgattaagagctcggagcttcaaaaagagattgaaaaagaaagcggtcttgaaatccctaatatgacaacgtttatgcaaagcttaattaaaatgtacccggaagtgaaaaagccatatcgcgggcagtacattttagagggtgaaatcgaatctgcagaatcagcaaacgagtaaatataaagaaaaactgcttggcatcgctcaagcagtttttttattgaggttttttctgtgaaggtttgttttctttttcaagattaagcttatacacccacttttgataaggcttttcttcagcggctctgtttttcagctcttcgattgtatggctcttggcctggtctgatgattgggcgtgggcaagctgtttttgaagcacatgtatctgtttggtgacatcttcaaggatggtctctacatgatttggctgcgcgtataccgctggagcttcttcttccgttttttctttttgttttgtgccgccatcaatatcggcaaaatgagaagcaatccaggcatcgctttcatcaagctgccgtttatacgatataatagtttcgtgaaataatttttctttcgttttttctatgtctagcagtctttctttcgtttctatgattcgatctttcatatgatcaacttctattttaatatgttttagctgatattctttttctaccatttgctcttttagacgcccgttttcggcttttatcaattcggcttgctgttttgcctgaagcagtgcattttgttcctgctcaattgaggcttgaagttcgctgatccgtttatgaagatttttattttcttcttcgattttgactttagcaatatgaagtttatgtttttcttcgatttcggctctgcgtttataggtttcagcagatagaagctcctgcaaaacaacgattttatcaagcagttcagctcttatttggtgcagggtttggctggtgtgggaggcatgtttttcttttgttgacatatgtgttaattcggcagacagctgctggagcttttctttcatatcgttattttctttgagcagtttgttatttttctgatgaaagtagcttgcttcaagttcagaaatcagcttatggcaccttgaaagctcggattttaaataaaggttctcctgagacacgtcgtggaaaaaaggacctgatcttttcattcgaaccatctccctcatgatgttaacactacaatatgcaaatactgaacagctattcctctttaataaacagacaagcagtagcgttgagcctttgcttttgctatgcttttaacgaaactagaggtgagatgatatgaaggatgtaaacgtactgctggcagggggagcctcgcggcgatttggagaaccgaaggcgtttgtcaaatggaagggcaggatgctttacgaatgcgctaaagaggcacttggagaacaaacggttatcatcagccgtcccgaatttattgatagatttcaagaaaacggtgaaaatgaagtgtatcaagatgctaagccatttcaaggcatggggccattggctggtatatataccgcttttaaaaagacaaacggtgatctttatactgttctttcctgtgacacaccgctgatacaaagaaggacgatgctggagctcaaacgtctgatgactgccggtgcggacgcggtagtcccaatttcagacggacaagtgcagccattgattgcgatttaccacaaacgtatcatgccagttctatacgatcagctttctgagaagaggttgagaatatcagatttattaggcagaatttcggtttgttacgtacaggctgaaaatatcggagcaaacccggcagagtttatcaacattaatacacgtgatgattttagctgtttggaagaaaaatcgaactccctcaagcgggactgacggggcaataacatgataagatgacataaaagataaggagaacaggtttgatggaggaacgttattcacggcaaatcagatttaagcaaattggggaagagggccagaaaagactggcagacagccatgtgctgattgtcggagcgggagcgctcggcactgcaggagctgaagggctttcgagagcgggagtcggtacgattaccattattgaccgtgactatgtggagtggagcaatcttcaaaggcagcagctttatacagaaagcgatgccaaactccgcatgccgaaagccatggctgccaaagagcatctatcagcgattaacagcgagatacatattgaggcgtatgttaccgaaggaacagccgaaacgcttgagccgctgattgaaaaagcagatgtcgtgattgacgcgacagataattttgaaacccgcatgctgataaacgatcttgcccagaaaacaaagacaccttgggtctatggcgcctgtgtaagcagccagggaatgttcatgactgtcattcccggagaaaccccttgtctgtcttgtttgtttgatcaaattcctgttggcggggcgacgtgtgatactgccggcattattccgcctgctgtgcatatcgtttcagcatatcagcaggctgaggcatttaagctgttaaccggccaaatagaagcaatacagcggggttttgtgacatttgatgtctggaacaattcgcatatgaagattaacgttaatcatgtacgccgtgaggattgcccatcttgcggagcaaatgcggtatatccttatcttcaggattggaatacaccaaaagctgctgtattatgcggccgtgatacagtgcaggtaaggtcagaatcattaaaaagaatcccgaaacaggaactcattaagcggctgaaaacaatcggcaaggtcgaggctaatgcgtttttgctgcatattttttacgaggatttcagaattgtcattttcaatgacggacgggcactggtgcatggaacaaatgatgtgaaagaagccaactccgtgttggcaagagtgattggactgtaacaacaggaggggtcagaatgctggagaaaagaacaccgataccggtagacgaggcagttcggcgtgtctgccattttcaaaaacaaggtgaaacagaatgggtggcgcttgaagacagccttcatcggtttttagccgaagatataactgcggatcaccacgtccctgcgtttgaccgttcgccatacgatggttttgctgtcagagcgtgcgatacggcatatgcatcacgtgaaaacccagttcggtttgaagttattgaccatattggagctggggcagtatctgaaaaagaacttggcccgtttcaggccgtgcggattatgactggcgcgcaaatccctgaaggggcagatgcagtcgtcatgattgaactgactcaaacctttgaggagaatgggaagtcatttatgtctttaaaacgccgctttcagacgggggataatatttcaaaaacaggtgaggacgctcaaaaagggagtgttttactgacaaagggtacccgggtgacaccaggagtgacggctcttttggcaacattcggatacgcatctgtgcctgtcgtgagaaagcctgtagtcgggattatcgcaaccggtaccgaattgctgaatgtcagtgatccgctggaaccgggaaaaatccgcaacagcaatgcgagtatggtatatgcgcaagcgatagaagcaggcgcaacaccgctttatttagggaaaatctctgatgaactggataaaagctttgctgcagttaaagaagcgatgaaaaaggtggacttcctgatcacaactggcggtgtgtcagtcggtgactttgactttttgcctgcgatctatgaaaaactcggagcggacgtgctgtttaataaagttgccatgcgcccgggcagcgtgacaacggtggcgcatgcaaacgatatgctgctgtttggcctttcaggtaatccttcggcatgctatgtcggttttgaactgtttgtcaaaccgataatccagacatggctgctcaatgaaacaccgcattcgatttgtgcggaagctgttttgaccaaggattttccgaagccgaacccatttacccgatttgttcgtgcgctcgtgcaccatcaggaagggaagctgttggcgacacccgtcggattagataagtcgagctccgtcacatcacttgcagatgccaatgcatttattatcctgccgggcggcacgcgaggctacgaaactggcagaacggttcaagtgctgctcatcagagaagagaatggaagtgaatggccttggtccgtcctttcccgatcgtccaagttgtaggatttcaaaacagcgggaaaacaacgtttattgagcgcattcttgaaaaagcctctgaacagggagtctatttgggctgcctgaagcatcatggtcacggcggtgaaccgcaagcgctcacggaaggaaaagacacggaccgttacaaggcggcaggtgctgatgtaacagcggtagaaggtgctggtgtgttacagctgactgcccgccgcaattgggatttggcacggctgatcgagttataccaatttctcgaaacagactgtcttctgattgaaggctttaaaaaagccccttatcctaaagtggtaattctaagtgaaaaggaagatctggaagcgctgcaagcagtaaatataatcgccatcatctatagaaaaaaagagcatatgacagagcatcagggattacccgtttttcatgcggatgatccggttgccgtggattttgtgctttcacagctgaaggaggaatctgcataatggaacggtttgagattacgaaaacacccattaatactgaagacatcatcaaaaaagtggagaaacgggaagcaggagccattacgacatttattggtacggttcgggaatggacaaacggaaaaagaacggttcggcttgaatatgaggcatatgaaccgatggccgtgcaaatgcttgctcaaatcggcgctgaaatcgaagaaaaatgggaaggtgcctcagctgcgatcacgcaccgtataggtgtgctcgatatcggtgaagcagcggtggtgattgctgtatcttctccccatcgaaaagccgcatatgaagccaatgagtatgcgattgaacgcattaaacagattgtgccgatttggaaaaaagaaatttgggaagacggtgagcaatggatcggcgaccagctagaaacaacagcttatccgaacggaaaaccagacctaagcgagggagagcagcatgattaaaattcttttatttgcagggcttgctgaacaggccggtacacaagcaatagaaatagatatggaacaagcaaccacagatgaaataaaagcgagtctaaaagaacaatacggtcttgaatctattgatacggctatgattgccgttaacgaaagctatgtaaaagaaaatacctctgtatcttcaggtgacacggtagccatcataccgccggtcagcggggatgaaaaccggacggcatttcagccgtccggtttttctgtatttcattggcatatccccaagtatccccagcatacaatgattttctgtaagcgtttattctacatatggtactccctataaagtaagagactcattccataattagactgaaattttgaaaaataatagaaatttatttcgggtatcgatatagtaaagatgataaatgttggaaaggtgctggatatggagacatttaaaagattaaaaatgtattattggccgtatagaaaagtgtttatgtggtcgcttctagccatgcttttgatgactgcaattactgtcgtttatccgattatcctgcaaattacgattgatgagatcgtgctgggacggcagtatcagcttgcggcgtgggtcagcttaggatttattgcggtaatggttttgaaaggaacggctaccttttttcatcagtatttaggtgatatgttcgggatcaaatccgtttatcggctgagaaatggtctgtatgaaaaactgcagcggctttctttttcttactatgataacgcgaaaacaggagatttgatgtccaggctgactgctgatgttgaagggcttcgttttttcttatcatacggtctcgctgagctcattcgattcggcctgctggtagccatcagcctgtcggttatgttttactattctgttcctctcacgcttgtgacaatagctgttctgccatttctcgcggttgcggtataccggtttgacaaaagagtccatcccgccttcagaggcatccgcaaatcgtttgcgaaactcaatacaaaagtccaggaaaatatcagcggcattaatacggttaaatctctttccagggaagattttcagatcagcactttcaataaagccaatgcagaatacagggcgcagtatttacaaacatcatccatctggtctgcgtatttccctttaatggagttcattggtaacatttgtattgtagctcttctctcatacggcggttacttggttatgcaaaatcagctcaatcccggcgagcttgttgctttcttcagccttgtcaattatatgatgtggcccattatgaacttaggttttgtcatcaatatgttctctcaagcaaaagcgtcaggggaacgcctgctcgacattctggaaaaagaagaagacattacagatcatcctcatgctttgcataaacaaaaattaaccggagatgtccatttcaaaaatgtttctcttgcatacgggaaagaacaaacaaacgcgctgtgcaatgtaagctttgaggcaaacagcgggaaggtaatcggactgttgggcccgacaggttcaggcaaaagctcagtgacacagcttctcaccagattttacagtcctgttagcggaatgattaccattgatcacaaacccatcacagagtattcgttaaaaacccttcgttccaatatcggggtcgtacttcaagaatccttcctgttttcatctacgattagatcaaatatttcgtatgggcggccggatgcctcaatggaagacgtcatcgaagcggcaaaaagggcgcaggctcataactttattatggagcttcctgatgggtatgacaccatgctgggagagaggggaatggggctttccggcgggcagaaacagcgaattgccattgcgagagccatttgcttgaacccgagcattttaatattggatgatgccacaagtgcagtagatatgcaaacggagcacagcatacagcttgccttaaaagaagtcatgaaaaaccgcacaacctttatcgtcgctcaccgcatttcttcactgaaacacgccgatgaaattctcgtttttaataaaggacgcattcgtgaaaggggaacacatcatgagcttcttgaaaaaggcggctactataaaaagatttacgatttgcaataccgtgatgtcaaaatgattaatgagccgcatgaggtcggatagggagggccaaatgaaacaagcgaaaaaacaggggattttagagcgtttctattactcttcagatgaaattattgaaaagccgtttaactgggctcaaatgtggcggctgctgagctatgtcaaaccatatcgaaaaacaattttgccgctttcttttctcaccgtattgattggcactgctgtgaagcttgtgatccccattctgatcggcgtttatgttcttgatcaagcgattacagggagaaactcggagctgctgattcagctcatttttattattagcggtttatatgtcctcaattacgccgccaatgtgttaagaatcaggtggatgaatcagcttggccagcatgtcatttacgatttgcgacagcatttatttacccatgtgcagcgcttatcccatcgattttttgatcagcggtcggcgggatcgatcttagtcaggatcatgaatgatattaactctcttcaggagctctttacaagcggagtcatcaatttgttgaccgacttgctgcttctggccggcgtgattatcattttgtttacgctgagccctgagctgactatagccatcatggtgacattgccgattatgttttttatttcaacaagtctcagaaaaaaaatacgccgatcctggcaaacggtacggctgaagcaatcgaagctcaactctcatctaaatgaaagcattcagggcatccgggtcacacaggcatttacgcaggaagaagaaaacatggcgtattttgacggtgtcaatcaggagaactacgaatcatggcgggaagcaactagaaaaaatgccatgttccgtccgctggtagaaatgacgaatgcgattgggacggctgtcttgatttggtatggagccacactcatcatgaatgaaaccattacgattggcgtcttcgtttcttttgctttctatctgggaatgttttgggaaccaatttcgagactgggtcaggtctataatcagctgttaatggggatggcatcatcagaacggatttttgagtttctggacgaacagccaaatgtcaaggagaagccgaatgccattcataaggaaaagataaatggggagatcagttttgaagaggttgaattttcgtatgatgaaaaacgaaaagcccttcacgccgtttctttctctattcctgcaggctcgacgcttgcgcttgtcgggcatacagggagcgggaagacgacgattgccaatttaatcagccgattttatgatgcgaccggaggcaccattaaaatagacggtataccgattaaggatctttcccttgccagtctgcgctctcaaatcagcattgtcctgcaagatacatttattttctctgggaccatcatggaaaatattcgttttggaaggccaaatgcttcggatgaagaggtgatgaaagcgtcccaagcggtcggagcggatgagtttatttccgatttagcggaaggatacgcaacagaggtggaggaaaggggcagcgtactgtctgccggtcagcgtcagctcatttcctttgcaagagcattgctcgccgatccggctattatcatccttgacgaagcaacggcaagcattgatacagagacagaagtgaaaattcagcaggccctaaaaacgcttctgaaagggcgtacagcagtgatgattgctcacagattgtctacgatccgcgatgccgaccgcatcattgttcttgatcacggcaagaaaatagaagaaggaaaccatgagcagctgctcgctaaagaaggcgtttatgccggacttgtgaaagcgcaatacagcacagcgatagaataatatgaaaagccttcagtataaattgaaggtttttggaaatttattagaaaaacatgaaactttttaatatccttcccgtactattggttagatattctcaaggaggttttgaaatggaaacgaatgtagaaaaaaacagtggaacggcggctgaaaagccttcacttttcggagtgatcacaagtccatccgttcaatttgaaagaattagagaaaggccggctgtatggggaccgcttttgattgtcgcagcaattatcatcgtcggtgctgtgctgcaatcactcggtacggattatagtgagcttttgaaaagccaggatacgcaagggctatcagctgaacaaaaggaggctgtcgcaacaataaccaaatttggcggaatggcaggcgctattatcggcggtatcgcagcattatttattgcccctcttatttattggctctgtgtaaaagcatcaggcggtgttacgacatataaaaaaatgctttctctcggtctgtttgtctctttgattagcagtctcggattattggttaatggaatcgttgcttttacgactgacgtgaatcctctttacagcacgacgtcactggcagggattatcccatctgacggggctcttgccagcgtgttaaatacctttgaaattttcagcatctggagctttgtattattagcaatcggacttcacaaaacgggaggcatctccaaaaaagccgggtggatttcagcaatcattctattcggaattttagttgtattttcgctcttttcaggtttaatcaattctgtggcgggtgcataggctcatgaaaaaagtctggatcggaattggaatcgcagttatagtcgctctttttgttggaatcaatatataccggtctgccgctccaacaagcggcagcgccggcaaggagatacagacggggagcgttgaagaaaatgaaatctcatcaacggttatggttcctggcacgctaaaattttcaaatgaacagtatgttttttatgaagcggataaagggacattagaagacattaaagtaaaggaaggtgataaagttaaaaagggcacgcctttagtcacctatacaaatgagcagctgagcctggaaaaagaacagaaccagttaacgtctgaatccaaccggcttcaaattgaccaaattcaagaaaagttaaaagccttagacagcaaagaaagagaactggaaaaacaggtaggaaagaaagaagcagaaaaacaaatcgaatctgaacgaacagagcttcaaatgcagaaaaaaacagcggagatcgaattaaaacaaaccgagcttcagcgacagtcacttgccaaccgggtatcagatttagaagtgaaaagcgaaattgaaggcaccgttatttctgtcaaccaagaagcggcatccaaaaagtcagatattcaagagcctgtcatacatatcggcaacccaaaagaccttgtcgtctcagggaaattgtctgaatacgatacattgaaagtcaaaaaaggccagaaggtcacactcacttcagatgtaatacagggtaaaacatggaaaggcacggtttccgcagtcgggcttgttccggatcagcaggagagcgctgcggcacaaggaacagaacaggcggtccaatacccgcttcaagtgaaaataaaaggaaatcttccagaaggaaagccaggctttaaatttatcatgaatattgaaacagataaacggaaagcaaatacgcttccttcaaaggcagtcaaaaaagaagatgaccaatattatgtgtatacagtaaaagacggaaaagcaaagcgagttgatgtcaaaatcggcgaagtgacagatgacctgacagaaattaaagaggggctttcccaagatgatcaagtcattttgaatccatctgatcaggtgactgacggaatggaagtgaaatcttaaatgattcagctttctaatgtgcgaaaaagctaccagatcggaaaggaaacgtttgatgttctccattctattgatttggacattcatcaaggtgaatatgtctcgattatggggccgtcaggatcagggaaatcgacgatcatgaatattatcggctgtcttgatcggccgacttccggtacatatcaattggacggcgaagacatttcttcatataaagataaagaactggcggcagtccgtaaccggtccatcggttttgtatttcagcaatttcagcttcttccgcggctgaacgcaaaaaaaaatgtcgagctgccgatgatttattccgggataggcaaaaaagaacgtcaagagcgggctgagagagcattggaaaaggtcgggttagccaatcgaatgctccacatgcccaacgagctgtcgggtgggcagaagcagcgggtggcgattgcgagggcgatcgtgaatgagccgaaattgattttagctgatgaaccgaccggtgcgctggatacgaaaacaagcgaggcgattatggatcagtttacagcattaaatgccgagggaacgacaatcgttctggttactcacgagcctgaagtagctgattgcacgaatcggatcgtcatggtgcgtgacggaaacattgttcctgccagctccggacaaaggagtgtgggagaatgagcctgttagaaaacatcagaatggctctaagctctgtccttgcccataaaatgcgttcgatcttaacgatgctcggcattatcattggtgtaggctctgtcattgttgtcgttgcggtaggacagggcggcgagcaaatgctgaagcagtcgatcagcggcccaggaaatactgtggagctgtactatatgcctagcgacgaggagcttgcaagcaacccgaacgccgcagctgaatctacgtttacagaaaacgatattaaaggtttaaaaggaatagaaggtattaaacaagtcgttgcttcgacttctgaaagtatgacagcgcgttatcacgaagaagaaaccgatgctacggttaacggaatgaatgatggatacatgaatgtcaattctttagaaatcgaaagcggcagaacatttaccgacaatgactttctcgcggggaatagagccggaatcatctctcaaaagatggctgaagaactgttcgataaaacctcccctttaggtgaagttgtctggataaacggacagcccgttgaaattatcggcgtgctgaaaaaagaaacaggcttgctttctttcgatttaagtgaaatgtatgtgccatttaatatgatgaaatcctcttttggcacaagtgatttcagtaacgtatcattgcaggtcgaatcagcagacgacataaaatcggctggaaaagaagcggcacagctggtaaatgacaatcatggcacagaggattcgtatcaagtgatgaacatggaagagattgcggccggaattggcaaggtaacggcaattatgacgacgattatcggctcaattgcaggtatttcccttttggtcggcggaatcggtgtcatgaatattatgctcgtatcagtcacagaacggacgcgggaaatcggaatcagaaaatcacttggtgcgacgagaggacagattctgactcagtttttaattgaatcagtcgtattgacgctgattggcggactgatcgggattggtattggatacggaggggccgcgcttgtttcagccattgcgggctggccgtcactcatatcctggcaggttgtatgcgggggcgtgctgttcagtatgctcattggtgttattttcggcatgcttcctgcaaataaagccgcaaagcttgatcccattgaagcgctgcgttatgagtagcctcatgcaacatgcatgaggtttttttatgtttagtgatttctactatgaatataaaagacttttttcattaaaataagaagaaaatgtcgtacaattgtccttatttttgtcgaatttacagtttacaaaccctatagacatacgttaatatggagaaacgtgaaagattttgatagttattgaatgaatttgaatgattttagttgcctaaaccgaaaatagcgtttacaatgaaattgtattcaaaatgaatacgttttcattaggaggtgaagcatgctaactcctgaacggcatcaattgattattgatcaaatagaaaagcatgatgtggtaaagattcaagagcttataaatctgactaatgcttctgaatcaacaatcagaagagatttatcgacacttgaagaacgcggttttttaaagcgcgttcatggtggagcggccaagctttccgatatcagacttgaacccgatatgcttgaaaaatcatccaaaaaccttcacgataaactgaagattgctgaaaaagcagcttctcttttagaagaaggggattgcatttaccttgatgcaggcacgacgacattgcacatgattgattttatggataaaaccaaagatattgtcgttgtcacaaacggggtaatgcatatcgatgcattaataaggaaagaaatttctttttatctgcttggaggatacgtaaagcacagaacgggcgcgattattggaggcgcttcactgattgccatggaccagtacagatttgacaagagttttctggggacaaacggtgtccatacagaggctggattcacaacgccggaccctgatgaggcccttttaaaacagaaagcgatcaaacaggcaaaacacgcttacgtcttagcagacccttcgaagttcggagaaatttcattttcggcattcgccggaataggcgacgcaacaatcattacgactgacgctgaagagcttacattcgataattaccaagaaaaaactgtcgtaaaggtagtgaaaccatgatttacactgtaacacttaatccatctgtcgattatattgttcacgttgaagattttactgtaggaggcctgaaccgttcttcgtatgataccaagtatccagggggcaaaggcatcaacgtatcgagactgctgaaaagacaccatgtggcgtctaaagcgctcggattcgtcggcggatttaccggagaatatatcaaaacatttttacgggaagaaaacctggaaacagctttttctgaagtaaaaggggatacccgtatcaatgtaaagctgaaaactggtgatgaaactgaaattaacgggcagggaccgacaatttcggatgaagatttcaaagcctttttagaacagttccaatctttgcaagagggagatatcgttgttcttgcaggaagcattccatcttcactccctcacgatacttatgaaaaaatcgcagaggcctgcaaacagcagaacgcacgagttgttctggatatctcaggcgaggctcttttgaaagcaacagaaatgaaaccatttttgatgaagccaaatcaccatgagcttggagaaatgttcggcacgaccattacatctgttgaggaagccgttccttatgggaaaaagcttgtagaacaaggcgctgaacatgtaatcgtatcaatggccggagacggagcgcttctgtttacgaacaaagctgtttattttgctaacgtgccaaaggggaaattggtaaactcagtcggagcaggggattccgttgttgcaggtttccttgccggaatttccaaacagctgccgcttgaagaagcattccgcttaggagttacttcaggcagtgctaccgcgttctctgaagaacttggaacagaagaatttgtccagcagcttcttcctgaagttaaggtcacacgtctatagaggaggaaacacaagtgaaaataactgagcttttaacgaagcatacgataaagcttaatattgagagcaaagaaaaagaaaatgttattgacgaaatggtcactgttcttgataaggctggaaagttaaatgaccgacaagcctataaagaagccattttaaatcgcgaaagccaaagctccacgggtatcggtgaaggaatcgctatcccccatgcgaaaacggcaagcgttatcaacccggcgatcgcgttcggacgttcaaaagacggcgtcgattatgaatcattagacggccagccggctcacttagtgttcatgatcgcggcaactgaaggcgcaaacaacactcaccttgaagcattgtcaagactttcaacgctgttaatgcgtgaagaaatccgtaagcagctccttgaagctgagtctgaagatgccatcatcgacattattaatcagcacgataaagatgatgacgaagaggaagaagaagaagcggcaccagcacctgccggaaaagggaaaattttagcggttactgcatgcccgacaggtattgcccatacattcatggctgcggatgcccttaaagaaaaagcgaaagagcttggtgtggaaattaaggtcgaaacaaatgggtcaagcggcattaagcacaagctcactgcccaagaaatcgaagatgcacctgcaatcattgtcgcagcggacaagcaggttgaaatggaacgttttaaaggcaagcgcgtacttcaagttcctgtaacggcgggtatcagacgtccgcaagagcttatcgaaaaagcgatgaatcaagatgcgccgatttatcaaggcagcggcggcggttctgcagattcaaacgacgatgaagaagcgagaggcaagtctggaagcagtatcggaaacgcgttttataagcacctgatgagcggtgtcagcaacatgcttccgttcgtagtcggcggcggtattctcgttgcgatttcattcttctggggaattcactctgctgatccgaatgatcctagctacaacacgtttgcagcagcattaaactttatcggcggcgacaatgcattaaaactgattgttgcagttctggccggtttcattgcgatgagtattgcagatcgtcctggttttgcgcctggtatggtcggaggatttatggcaactcaagcgaatgctggattcttaggcggcttaattgccggattccttgccggttatgtcgtgattttactgaaaaaagtatttacgtttatccctcagtcacttgatggattaaaacctgttttgatttacccgctgttcggtatttttatcactggcgtattaatgcaatttgtcgttaatacacctgtagcggcatttatgaatttcttaacaaactggcttgaaagccttggtactggaaaccttgtgttaatgggtattatcttgggcggcatgatggcgatcgatatgggcggcccgcttaataaagcagcctttacgttcggtatcgccatgatcgatgcaggcaactatgcgcctcatgcagcaatcatggccggcggtatggttcctccgcttggtatcgcacttgcaacaaccattttcagaaacaaattcactcagcgtgaccgtgaagctggtattacatgctatttcatgggagctgctttcgtaacagagggagcgatcccatttgctgcggctgatccgcttcgcgtcataccagctgctgtagtcggtgcagctgttgccggcggattaactgaattcttccgagtaacgcttccggcgcctcatggaggagtattcgtagctttcattacaaaccatccgatgctttaccttttaagtatcgtgatcggtgctgtcgtgatggcaattatcctcggtatcgtcaaaaaacctgttacagaaaaataagaaaaaaagcgtccttggttcgaaaggacgctttttcttatccggccggcagggagcgcggttaagttatgtattttattcttttttatgataaagtaaaagaagagaaacaactgacatagcaattgtctaggaggaaacactttgaccgaggaaaaaaatacgaatactgagaaaacggcgaagaaaaaaaccaatacgtacctggaatggggtaaagcgattgtcatcgctgttctgctggctctcctgatccgtcactttttgtttgaaccgtatttagttgaaggttcatctatgtatcccacattacatgacggagaaaggctgtttgtgaataaaacagtcaactatatcggcgagctgaagcgcggagatatcgttattatcaacggtgaaacttctaaaatccattatgtaaaaagattgatcggaaagcctggagaaaccgttcaaatgaaggatgacacgctttatataaacggtaaaaaagtagccgagccttacttgtctaaaaacaagaaggaagcagaaaaacttggtgtcagtctgacaggagactttggaccggttaaggttccgaaaggcaaatactttgtcatgggagataaccggctgaattctatggacagccgaaacgggctgggactgatcgcggaagatcgaattgtcggcacatcgaagtttgtctttttcccgtttaacgaaatgcgtcaaacaaaataaaaacgccttgctggcctttggacagcaggcgtttttattttgaaaaagaagcgactaatgcaatgcataaaaccgtgatgaacactgaaccgataatagctagcacactgaagaaaaggtgaacctgtttgttctcttttccgcgcttttctaaaagccgtttagaaaaaatgtgcgaaaatatgtaaataagggctatgcctatatataagccgatatctttggcggtaaagcctgttacggcaaggtaaaagcccgtaaaaaagatcagtaagcaatattcagtaagtgttaaaagcctcaacgtgttcctccatgagagtgtgtaattttccaggcggatgcattctctctctttaattgtaacacagctggctggtttgggtgtataagtgttttctctctgttttatcagggaatcatttctcttgccctgcattcatggtatacttttattgatgatagacatgatggaggataataaatgattgctgtaaataatgtaagcttgcggtttgcggatcgcaagttatttgaagatgttaatattaaatttaccccaggcaactgctatgggttaattggtgcaaacggtgccggtaaatcaacgtttctaaaggtgctgtcaggcgaaatcgagcctcagacaggcgacgtgcatatgagtcctggcgagcgtcttgccgtcttgaagcagaaccattttgagtacgaagagtatgaagtgctgaaagtggttattatgggccacaaacgcctgtatgaagtcatgcaggagaaagacgctatttacatgaagcctgatttctcagatgaggatgggattcgtgctgctgagctagaaggtgaatttgcggaactgaacggttgggaagcggaaagtgaagctgcgatcctgttaaaaggtcttggtatctcagaagatctgcacacaaaaaagatggcagacctcggcggttcggagaaggtaaaagttctcttggcacaggcattattcggcaagccggatgttctgctgctcgatgagccgacgaaccacctggaccttcaggcaatccagtggcttgaagagtttctgattaactttgaaaacacagttattgtcgtatcccatgaccgtcacttcttaaataaagtatgtacgcacattgccgaccttgattttaacaaaattcaaatctatgtcggaaactatgatttctggtacgagtcaagccaactggcgttaaagctttctcaagaagcgaacaagaaaaaagaagagcagattaaacagcttcaagagtttgtcgctagattcagcgccaatgcgtctaaatctaagcaggctacatcaagaaagaaacttctcgaaaaaatcacgctggatgatattaaaccgtcttcccgccgctatccttatgttaacttcacgccggaacgggaaatcggaaatgatgttcttcgcgtggaaggcttaacaaaaacaatcgatggcgtaaaggtgcttgacaatgtcagctttattatgaatcgagaagataaaattgctttcactggccgaaacgaacttgctgttactacgctgtttaaaatcatttccggggaaatggaagctgacagcggaacgtttaaatggggtgttaccacatctcaggcgtattttccaaaagacaacagcgaatatttcgaaggcagtgatctgaaccttgtagactggcttcgccaatattctccacacgaccaaagtgagagctttttacgcggtttcttaggacgcatgctgttctctggagaggaagtccacaaaaaagcaaacgtactctccggggagaaaaggtccgctgtatgctgtcgaaagcgatgctttctggcgccaatattttaattttggatgagccgaccaaccatttagacctagagtccattacagcgctcaataacggcttaatcagctttaaaggcgctatgctgtttacttcccatgaccatcagtttgttcagaccattgccaacagaattatagaaattacacctaacggcatcgtcgataagcaaatgagctatgacgagttccttgaaaatgctgatgtgcagaaaaaattgactgaactatacgcggaataaaaaagcagagatttctctgctttttttgatacctaaatatgaaaggagatcacaacatgaaatttttggttgtcggagcaggtggagtaggcgggtatattggcgcacggctttcggagaaaggaaatgatgtgacatttcttgtgcgccaaaaaagagctgagcagctgaaagaaaccgggcttgccatccatagtgaaaaagggaatgtatcatttcagcctgaactaatcagtgccggagaaacagggcaatttgatgtcgttatcattgcttctaaagcatactcgcttggtcaagtgatagacgatgtcaaaccatttatccatcaggaatctgtcattatccctttcttaaacgggtaccgccactatgagcagctatttacggcattttcaaaagaacaggtgctgggcggcctgtgttttatagaaagtgctttagacaacaaaggagaaattcatcatacgagcgcatcacatcgttttgtatttggagaatggaacggcgagcgtacggagcgaataagagcgcttgaagaggcattttcaggtgtgaaggctgaagtcatcattagcgggcatatcgagaaggacatttggaaaaagtatctctttattgcagcgcaagcggggatcacaacgttatttcaacgaccgcttggcccaatcctcgccacagaagccggacgtcacacggcccaaactcttattggggaaatttgcgctgttttacgaaaagaaggtgttccggctgatccggctcttgaggaagagagctttcgtacgatgaccagcatgtcttaccatatgaagtcctccatgcttcgggatatggaaaacggccaaacgacagaaggcgaccacctgcatggatttttgcttgaaaaagcaaaacgtttatctctcgcagcaccagtattagaaaccgtttatgcgaatctgcaaatgtatgaagcagaaaaataaaaaaaggaggcgaaaaagcctccttttatttacttaaaaagcccaatttccgtttctgaagataggctctcttttcccgtctgccgtaattccgtcaatattcatatccttagaaccgatcataaagtccacgtgtgtaatgctttcatttaggccttctttgacaagctcttcacgagacatctgctttccgccttcaatattaaaggcataggcgcttccgatcgccaaatgatttgacgcgttttcatcaaacagcgtgttatagaaaagaatgtttgattgtgatataggcgaatcgtaaggaacaagtgccacttcacctaaatagtgagaaccttcatctgtttccaccagttcttttaaaatatcctcacctttttcagctttaatgtcgactatacggccattttcaaatgtcagggtgaaattttcaataatatttccgccgtagcttaatggttttgtgcttgataccactccgtcaaccccgtctttttgcggcagcgtgaacacttcttctgtcggcatattggccataaactcatggccgttttcattcacacttcccgcacctgcccaaacatgcttcctaggcagcttaattgttaaatcagttccttcagcttgataatgtaaggcagcgtaatgtctctcgttcaaatggtcaactttttcatgaagattttggtcatgattgatccacgcctgaaccgggttgtcttcatttacgcgcgtcgctttaaaaatttcttcccacagaaggtggatcgcttcctcctctgatttgccaggaaacaccttgtgagcccagcctgctgatgccgcacctacgacagtccagctgactttgtctgattgaatatattgtctgtatgtatgtaatgctttgcctgctgctttttggaatgccgcaatccgtttggaatctataccttttagcaagtctgggtttgacgacacaactgaaatgaaagcagctccatttttggcaagctcttctctgccttttgcttcccattcaggatattcttcaaatgcttcaaacggcgctaattcgtattttaatttggcgacttcgtcatcctgccaattcacggagacgttttttgcgcccttttcatatgcgtgttttacaattaaacgaacaaaatcccggacgtctgttgaagcattgacgactacatactggcctttttggacattaacgccgacttctaccgccagctgtgcatatgtatttaatttctgtgaaaatgaatccatgaatcattcctccaagcttttttctcatcatatcaaatatgatcctataaaggaaagaaggagcccaaagtgaaaaacccaaaacgacacgtcttgggttttttcaatattatggatgattcagttttacagtgccgcctgcaggcgaatggggcatatttgccaaagaaatgctcatgcctccaagaataattccgcttaaaatggctgcgatcgctactcttcttcctaaatctcttagcatctgtttcctccttaacgtttctccatttcccacaatatgaaggaagtgaggaaaaaagaagcaagaaatttgccgcgtgtgagaattttgcgggtaaagactatttaattgccttttgcagcttatcaatcacttctaaagaacggcccgtgccgattgctacagattcaagcgggttttgcgccacgtgtacaggcacgacaatctcttctgtgagccattctttaattccattaaggagcgcgccgccgcctgttaaaataacgccgcgatcaacaatatctccgctcaattcaggcgggcagtcctcaagtgtcgctctgatggcttcaaggatatgcagaagggattcacgcattgcatcttgaatttcgttggattgaagcataatggtttttggaagacctgtcacgaggtcgcgtccccgaatttccattgcctctggtatatgttcaatcagagcatggccaatttccatttttacctgctcagctgtgcgttcgccgatcagcaaattgtattttttacggacgaaagaaacgatatcctcatcaagctggtctccgccgatcctgatagaatggcaggaaacaacgccaccgaaggaaataatagcgacctctgtcgtccctccgccgatatctactaccacattggcaaccggctcatcaaccggtaaatccgctccgatggcagctgcgactggctcttcgattaaatgaacgtttttcgcgccgcaatttttcactgcgtcactgatggcgcggcgttctactgctgttgagcctgacggtgtgcaaacgactacgttcggttttctgaacgacatgccgatgctttttgcggcttttttcataatgtgctttagcagatcagttgtcatatcatagtctgcgatcacgccatctttcatcggtctgacagcgacaatttttcccggtgttttaccgatcatgtttttcgcgtcagctccgattgcaagcactgattttgtcgtcgtatccactgcgacaacagatggttcatttaggataatccctttatttttgctgtaaacaagtatattagctgttcctaagtcaatcccgatttcagttgattgaaacatgttttcacccaatctctatcctaatttaatatgattctacatttaaagtttctcagaaatactgcgatttttgggggtgtgcgtcggtaaagaaatgtttttgtaaaaaatcaaggaactgtgtaacagaagtaatacatttttcggttttatggaaaaaatatcttgtaattcttatagaaagcgggaaactttttcaaagtttcattcgtctacgatatattgaggtacatccttaaaacattacatgagaaaagaaacatttaaaggaagaagggtttttatgaaatcaataggtgttgtgagaaaagtagatgaattaggccgcattgtcatgccgattgagttgagacgggcattggatattgccataaaagacagcattgagttttttgttgacggagataaaattatcttgaaaaagtacaaacctcatggcgtttgtttaatgactggagaaatcacttcagaaaataaagaatacggcaacggtaaaattacgctaagccctgagggtgcacagctgcttctcgaagaaattcaagccgctttaaaagaataaaattatgctaaaaaaggcggagcgatatcatctccgccttttttgcgtatcaatttttgattaccgccgcctaagataagacatcaagatatttggtaatgaatgatttgggatactttacatattttactcaattatttgtcgaagaatggtacaataagtagagaaacacaagcggcaggtggtcatatgagaaaatatcaagctcgtatcatttccatcattttggcaatgatttttataatgttttgggattatttattttattttataggcaaaaacccgattaattggcctgttgatattgtgtatactgcagtcacgctggtaagtgtctggatgttggcttattatattgatgagaaacagcagctggttaagaaaatgaaggataacgaatggaagtataaacagctttctgaagaaaaaaaccgcatcatggataatttgcaggaaatcgtatttcaaacaaatgcaaaaggtgaaattacatatttaaaccaagcgtgggcatctataaccggcttttcaatcagtgaatgtatgggaacaatgtataacgattacttcataaaagaaaagcacgtagccgaccacattaacacccaaatccaaaacaaagcgtcttctggcatgtttacggcaaaatacgtgacaaagaacggcacgattttttggggagaagttcattataaactttactatgaccgggatgaccaatttacaggcagcctgggtacaatgtcagatatcactgagcggaaagaggctgaagatgagctcattgagattaatgaacggctggcgagggaatcccagaaactatcaatcacaagtgaacttgccgcaggtattgctcatgaggtcagaaaccctttaacatctgtcagcggtttcctccagattatgaaaacacaatatccggacagaaaagactattttgacatcatcttttcagagattaaaagaatcgatttagtgctcagcgagttgctgctgcttgcaaaaccgcaggcaatcacatttaaaacacaccagcttaatgagatcttgaaacaagtcacgacattgcttgataccaatgccattctgtccaatatcgtcatagagaaaaatttcaaagagacagatggctgtatgattaatggagacgaaaatcagctgaagcaggtctttatcaacatcattaaaaacggaattgaggcaatgccaaagggcggtgtcgtaaccatttcaactgctaaaaccgcctctcatgcagtgataagcgtaaaggatgaaggaaacggcatgccgcaggaaaagctgaagcagattggcaaacctttttattcaacaaaagaaaagggcactggactggggcttcccatttgtttgagaatcctgaaggaacatgacggggaattgaaaatcgaaagtgaagctggaaaaggcagcgtctttcaagtggttttgcctttaaaatcagacagctgagaggagaaaaataaagtgaactcgcttctgtttgtatacgggacattaagaaagcatgaaaaaaaccatcatttgctggcacaatcggcatgtatcaatgagcaggcgagaacaaagggaagtttgtttgctgcaaaagaggggcccacagttgttttcaatgatgaagatgaaggctatatatatggcgaagtatatgaagcagatgaattgtgtatacataagctcgatcaattttttcaaggatatcataaacaaacggtgtttgtagaaacggatgtcgggattaaaattgcgcttatttattttatgaacaaagacgggtgtgccggttttacgaaaataagcagcggcgactggaaagaacatcagatgatcagcaaatcgaaaaatcccatttattattttgcctatggatcatgcatggataatgcccgctttcaaaaagcgggagtcgatcactattttcaagatccagtaggaagagctgttttaaaaggatacacaacccgcttcacgctaaaaagggaagacggttcaagagcggacatgttggaagacggaggaacaacagaaggcgttttataccgtatcccttattctgctctctcctatctatataaaagggagggcgtcgaatctcttacgtatcggccggcatttgtagacgttgaagctggcggaaggcactacaaagactgtttaacctttctcgtcctccaaaaagaagcggaaattgccccgcctcagcactatcagattgaaatcgaacgcggagcggagctgtatttgtcgcctgagtttactgaaaagctcaagcggcatatgaattcgctgccaaaaggataacactgtaacaaaagaatatgataaaatttgatcaatatcatgtcatataaaggagcaccacgatgaaaaaagaatttgcggtaattgggctgggccgttttggtggcagtatttgcaaagcattaagcgaagaaggcgtcgaggttatggcaatggatatcgatgaagataaagtcaacgagtatgccaagattgcatctcacgcagttatcggtgattcgacagacgaatctgtcctgaaaaatttaggcctgcgaaattttgaccacgttattgtagcaatcggggaaaatattcaagcgagtattttaacgacactcattctgaaagaacttggcgtccatacgattacagttaaagcgcagaacgattatcacgaaaaagtgctgtctaaaattggtgcggatcacatcgtccacccggaacgcgatatggcaaaacgaattgcgcataatatcgtgtccaacaatgtacttgactatttggagctgtctgaagagcatagtcttgttgaaatcgtagctaacagccgcctggctggaaatacgcttctcgatttagatattcgcgcaaaatacggtattaacatcgtagccataaaaaggggcaaggaagtcatcgtatcaccgcttgcaaccgaagtcatccaccaagaagatatactcattgttattggatcagttacagacatctcccgtttcgaaaaaagagttcttcatacaaaatagcaggcaaataagccgtcctcaaagggcggtttttcatattatcagaatataacaactttaatgaactgagcgtcaatttcttaaaatttcattgactaagcacaggcgttccgatagcatattgtaccatataataaaaaaaggaggggcctatttgaataaagaagcgctagtcaataggctgaatgcttcagccaaaagacaaaaagctgatatcgtcattaaaaacggaaaaatcatggacgtatataatcaagaatggatatatgaagatattgcgattacagatggagttattgtaggcctcggtgagtatgaaggcgaaaatatcattgatgcagagggacaaatgattgttccgggttttattgatggacatgtacatattgagtcgtcaatggttacaccgattgagttcgctaaagcagtgttgcctcatggcgtgacgacggttgttacagatccgcatgagatcgcgaatgtgtctggtgaaaaagggattgagtttatgcttgaacaagctcggcatacaccgctgaatatccattttatgcttccttccagtgtgcctgccgcaagttttgagcgatcaggcgcaattctcaaagctgccgatctcaagcctttttatgaagaagaagaagtattagggctggctgaagttatggattatgtgtcggttcagcaggctgaagaagacatggttcagaaactgcttgatgcccgtgtggcaggaaaaaggatagacggtcatttagctggtttatcaacagacctcattaacatttacagaaccgcatttgtcttaaacgaccatgaagtaacatcgaaggaagaagcccttgatcgtatcagaaggggcatgtatgtcatgatgcgtgaaggatcagtcgccaaaaacacgctcaatgtgctgccggcggtgaatgaaaagaacgcacgccggttctttttctgtacggatgataagcatgtggatgatttattgtcagagggaagtgtaaaccatcaggtgaaaatggcgattcaagccggacttaatccgtttttagcctatcagctaggaagcctcaatgcagccgaatgctacggattagatacaaagggagcgattgccccgggttttgacgctgatttgctttttgtatctgatctggaaaatgtcactgtcacaatgacgatggtaaaagggcagactgttgctgaagacagcaaagcggtctatcaggatcatgcttcaactgcagcaccagatcaggcactgcttgattctgttaagcttgctgctcctcttcacaaacaggattttcatatgccaatcgattcagagcagcagatcaatgtcattcaaatcataccaaatcagcttgaaacacgattagtacaagttccggctcctgttgcccgcgaatttgagcctgacactgagcttgatttgttaaagattgcagttgtcgagcggcataaaggattaaaagaaaccggacttggtgttgtgaaaggttttggattcaagagcggagcgattgccacaaccatttcacacgactcccataatattattgccgtcggaacgaatgatgaggatatcgcggcggcagttaataagctgcaggaaattggcggaggattaacaattataaaaaatggggaagagctccattcagtaccgctgccgattgcagggttattatccgaccaatctgcagagcaagtgaatcaaagcttgctgacgcttcatgataaattgccgttaatcggtttcacaggcggatttaatccatttttgacattgtcgtttttagctttgcctgtcattcctgatattaaaatgacgactacgggattattcgatgtaaaatcatttcaacacatatcactgcaataaaaagaggcactcccttagggagtgcctcttttttttaaacctccataatgatcggcaggatcattggacggcgctttgttttttcgtacaagaaaggtgcaagagtgtctgtaatctcgtttttgatttcagaccattgagtcgtttttcgttccattactttttgtaagtgatttgaaatgagctcttgagcatcgttgatcaagtcgccagattctctcatgtacacaaatcctctggaaatcaaatcaggacccgctgaaatcttgaagtcgtccatgtcaatgctgacaacaacaatgacaagtccttcttcagagagaattctgcgatcacgaagtacgatattgccaatatcaccgataccgcttccgtcaatgtacactgaaccggacgggatttttcctgcaactgaagcctcatcgcctttaagcgctaatacttcaccattatccatgataaagcagttttcctctgggatgccacaatctgttgcaagtttgacatgcatcttttgcattctgtactcaccgtgaatcggcatgaagaatttaggcttgattaaacgaagcatcagcttctgttcctcctgtccgccgtgaccggatgtatggatatcgttaagagggccgtgaataacctcagcacccgcacgatacagctggttgattgttcgactcacgctgattgtgttgcctgggataggggatgaagaaaatacgactgtatccccaggattgattgaaatttggcggtgtgtgccgtttgcaattcttgataacgccgccattggttccccttggcttcctgtacataaaattgttactttattagcaggcatacgattgatttcgttatgctcaataaacgtatttttaggacagttaatataaccgagtgtctgtccaatttcgatagccgattccatactgcgtccaaatacggcaacttttcttccattttgtacagcagcttcaattacctgctgcaagcggtgaatattcgacgcaaatgtggcgaagataattcggccgtccaccttgcggaaaatgtcatgaatgctttctcctacacggcgctcagacatggtaaactccggattttcactgtttgtgctgtctgaaagaaggcacaaaacgccttctttaccgatttcggccattttcgttaagtttgccggctcgccgactggagtaaagtcgaatttgaaatccccagtatgtacgatgtttccgggcggcgtttttacaacaatgccgtaggaatccggaatactgtgtgttgttctaaagaatgacacagccgttttgcggaactttacaatatcatcctcgccgataatgttcagtttcgtctgtctcaataatccatgctcttcaagtttattccgaagtaagccgatcgcgagttttccgccgtatacaggaatattcacttgtctgagcaggtatggaataccgccgatgtggtcttcgtgcccgtgggtgataaaaagccctttaattttatcttcgtttttgactaaatacgtataatcagggatgacgtagtcaattccgagcagttcgtcctcgggaaacttgatccccgcatcaatcagtacaatttcatcctggaattgcaccgcgtacgtatttttaccgatttcgcccaaacctccgagggcgaaaacagcagtctgatcattttttacaaatttcataccgctcataactccaatactttaaaattttcgctctgttgttcatattctaagaatgcaccatcaacaggtgtaataaactcaatattaaatttcttttctttcagctttgttctgacgtcacgctcagatacgccttcaatataaagtgaatctgtcttttcccgaacaggtacttcgtcagccttctcttgataaaataccttataaatcattccaaatctctccttaaatgccgtatgttagactcgctcattctattatattcgaaaacggaatataaggaaagccttgagcaaaataaggatctctcaaaaagtgaaagatcccttgtcaggcaattgctttcttacggagcattccgttccattgtcttctgagtttctttcttaatttacgcagcattagccagtccctcctttaatgaaaaatttgtcccagagttcttttatacaaatagtatacggagattgaggaagacttttcgtggttattaatggaatttaatatgatttttgaacgaaattgtttgctgaatgacaatctttttgtatgatgagggtgggaattgcagaccaagacgataaaggggaagttgcgatggattctaaattaatcttttttgatattgacggcacaatatatgatcatgataagaatataccggaaagtacgagaaaaaccgtggcggagctgcagcgccaagggcatcatgtgtttattgccagcggccggtctccatttttggttaagccgattttggaggagctgggcatccactcatttatttcctacaatggacagtttgttgtctttgaaaatcaagtgatttataaaaatccgctgcctgaagatgcaatcaggcgattattaaagcaggcggatgaaggcaagcatcctgttgtgtttatggctgaggacacgatgaaagcgactgttgcggatcaccctcatgttctcgagggaatcggcagccttaaaaccgattacccagagaccgatgaccttttttatgaaggaaaagaaatttttcagcttcttttattttgtcaggatgaagaagaaaaagcttatgccgcttttcctgagtttgatctagttcgctggcatgagctatcgactgatgttctgccgcacggaggttcgaaggcagaaggaatcaaaaaagtgattgagcgtcttccgtttgatatcggcgatacatatgctttcggcgacggattaaatgatctgcaaatgattgaatatgtagggacaggcgttgctatgggaaatgctgttcccgaactgaaagaaatcgcggactttgtaacaaagccggtggacgaggatggaattgcatacgctgtcaaagaattgggccttttaaaataaagaaatggctggcattgtgccagccgttttctcttttagcgctcaattgcgattgcattttcaggttctttgaaaggattttccttgtcaatatgatcatagaacataacgccgttcaaatgatcgatctcatgctgaaacacaatagccggaaatccttttaaacgaatatcaatattttcgccttctagtgttgttccttttactctgatgcgagcatagcggggaacataaccgggaatcgcttcatccacagagaggcagccctcgccgcttgttaagtagcttttttcaactgaatggctgacgatcttaggattaaacagagcatagctgtataatttaccggaagcatcttccgcatgaacggcgatcattcgttttttgatattaatttgaggagctgcgagtcctacgccagggcgcagcttgtatttttcggctaattccggattttggctgtttttaacaaattcgatcatgtcggccagctgctgtttttctgcatcagttggaggcagctcaacaggttcggcagtctctctgagggctggatggccgtcacgtacgatgttttccatagtaatcaagaaacttcactcctaaagcttaatatgtaaattatatcggatttcttcacaaaggtgcaacgaaacgaatgaccagccgtatatggctggtcaatttcatgctgtgtggttagcaacagcctccgcctaaataagcagctccgacaatgattaacagaatgaataaaacaacgattagcgcaaaggtgcggccgtagccatatccgcagccaccatatccgtaaccaccataactgcagcagcctccgccgtaaccatatccatacatattacataacctcctcttttaattacgccagagcctttataagtaggcatagcgtctaatataacctatgtaaaaacaaaaaagttgtatggtcatctgtcctgatttttcacttttttgatttaatttcagtattgcatttatacagcacggctattgccaaatgtccccatggattctatagtagaaattgtcaagattgggggatttaacgtgaaagacgcaataaaacggcggcctggaatgaagatcggagctttttgtgccatggcactgatattaacaggatgcatgggacaggacccggttgattcacttcatcattcattagaaaaagccgcggaatcggaaaagccgtttcaagaagaacaaaacacactcaaagaattagaggccaaagaaaatcagctttacgatagtgttatgaagctcaatatggatgattataaaaaaattgttgctttatctaataaggcgcttgaaaatgtcagcaagcgcgaagaacacctaaagcgtgaaaatgacagcatgaaaaaatcggaaacagaatttgaggaagcaaaaacgtcagcggaacatattaaggaaaaagacataaaagaaaaggccgatgccgcagcaaaccatatggagaaaagatatacatcatatggcaccatgtataaagagtataaaaaagcgcttgagcttaataaaaaactgtatatgcagctgaaagacaaagacttgacaagagatgatctggatcagcagatcgataaagtcaatgcttcttatgaaaagatccttaaatatagcggagaatttaatgaacaaaccgaaaaatataataaagcccgggaagatttatatgatgctgcaggctatcgtgtgaaaaagagctgactcgatcagctctttttttgaatatatgcgatacagatttcgttcaaaattttcatttctattgtagtacagcatagtaaggtatactagtacagttttgggtgcggttggcatctgtttttttgctgaaaatgtaaagcgaatacatttattgaaaatcagcgatgaaaacgattgacggttcttctttatttggtgtaaactaatccatgttaagcggtgttgtattagttttttacaacttcgaaataatacagttcaaagcagagtgtaactatcctactaaaaggttttggcaaactggggatcggctaaaatataatacgacttactgctgatactttagggtaccctaagtttgtatgtataaaaggaatgcacgtctaatgactgtttaaaagaaaggaagaggtgacttagtatggctgcaaaaacgaaaaaagctatcgttgacagtaagaagcaatttgatgccattaaaaagcagttcgaaacgttccaaattttaaatgaaaagggagaagtcgtgaatgaagcggcgatgcctgatttaactgatgatcaattaaaagagctaatgcgccgcatggtatttacgcgtgtgcttgaccaacgctctatctcattaaaccgtcaaggacgtctcggattttacgctcctactgcgggtcaagaagcttctcagattgcaacgcatttcgcgcttgaaaaagaagactttgttcttcctggataccgtgatgtgcctcagttaatttggcacggccttccattatatcaagcgtttcttttctctcgcggacatttcagaggaaaccaaatgcctgatgatgtgaatgccctttctccacaaatcattatcggtgctcaatacattcaaactgccggtgttgcgctaggtcttaaaaaacgcggtaagaaagctgtcgcaatcacttacactggtgatggcggagcttctcaaggggacttctacgaaggaattaactttgctggagcttataaagcacctgcaatcttcgtggtgcaaaacaaccgttacgcgatttcaactcctgttgaaaaacaatctgcagctgaaacaattgcacaaaaagctgtagctgccggtattgtcggcgtacaagtagacggaatggatccgcttgctgtatacgcagcaactgctgaagcacgcgagcgcgcaatcaacggcgaaggtccaacactaattgaaacacttacattccgttatggcccgcacacaatggctggtgacgatcctactaaatatcgtacaaaagaaatcgaaaatgagtgggaacaaaaagatccgcttgtacgtttccgtgcgttccttgaaaacaaaggcttatggtctgaagaagaagaagcaaaagtaattgaggatgcgaaagaagaaattaagcaagcgatcaaaaaagctgatgctgaaccgaagcaaaaagtaactgatttaatgaaaatcatgtacgaaaaaatgcctcacaaccttgaggagcaatttgaaatttatacacagaaggagtcgaagtaagccatggcgcaaatgacaatgattcaagcaatcacggatgcgttacgcacagaactgaaaaatgacgaaaatgtcttagttttcggagaagacgttggtgtaaacggcggcgtattccgtgcgacagaaggattgcaaaaagaattcggtgaagaccgtgtgtttgacacgccacttgctgaatctggtatcggcggtcttgcccttggtttaggcttaaacggcttccgtccggtaatggaaatccaattcttcggatttgtttatgaagtaatggattcagtttctggccaaatggctcgtatgcgctaccgttctggcggacgctggacttcacctgtaacaattcgttctccattcggcggcggtgttcatactcctgaacttcacgctgacagcttggaaggtcttgttgcacaacagcctggtatcaaagttgttattccatcaactccttacgatgccaaaggacttttaatttctgcgatcagagacaatgatcctgttgtcttcttagagcatatgaagctttaccgttctttccgtcaggaagttcctgaagaagaatacacaattgagcttggaaaagctgacgtgaaacgtgaaggtactgatctttcaatcatcacttacggcgcaatggttcatgaatcattaaaagctgctgaggagcttgaaaaagacggcatttctgctgaagttgtcgaccttcgtacagtaagcccacttgatatcgatacaattatcgcttctgtagaaaaaacaggacgcgcgattgtcgttcaagaggcacaaaaacaagccggtattgctgcaaacgtagttgcagaaattaatgaccgtgcgatcctgagcttggaagcacctgtacttcgcgttgcagcgccagatacagtatttcctttctctcaagcggagagcgtatggcttccaaaccataaagacgttcttgaaacagcaagaaaagtgcttgaattttaatcaaactgcataatcgagagggaagatgaacttttccctctattatatatctgttttcaatgcttacgatgtaaactttaaaattgcttaatcaaactaggaggtcgagaactgtggcatttgaatttaaacttccagatatcggggaaggtatccacgaaggcgaaatcgtaaaatggtttgtcaagcctaacgacgaggtagacgaagatgatgtactggctgaagtccaaaatgataaagcagtagtagaaattccttcacctgttaaaggaaaagtattagaattaaaagttgaagagggaacggttgcaactgttggacaaacgattattacgtttgatgcacctggttacgaagatcttcaatttaaaggcagcgacgagtctgacgatgcgaaaactgaagcacaagttcagtcaactgcagaagctggacaagacgttgcgaaagaagagcaagctcaagagcctgcaaaagctactggcgcaggacagcaggatcaagctgaagttgacccgaacaaacgcgtgatcgctatgccttccgtacgtaaatatgctcgtgaaaaaggcgtagacatccgtaaggttactggttcaggcaacaacggacgtgttgtaaaagaagatatcgacagctttgtaaacggaggagcgcaagaagctgcaccgcaagaaacagctgcaccacaagaaacagctgctaaaccggctgctgcaccagctccagagggcgaattcccagaaacacgcgaaaaaatgagcggtatccgtaaagcaattgcaaaagcgatggttaactctaaacacactgctcctcacgtaacgttaatggacgaagtggacgtaacaaaccttgttgcacatcgtaaacagttcaaacaggttgctgctgatcaaggaatcaagctgacttacttgccttacgttgtaaaagctcttacatctgcactgaaaaaattccctgttttaaacacgtcaattgacgataaaacagatgaagtcatccaaaaacattacttcaacatcggtatcgctgctgacactgaaaaaggcttgcttgtaccggttgtgaaaaatgcagatcgtaaatctgtctttgaaatttctgatgaaatcaatggccttgcaacaaaagctcgtgaaggcaagcttgctccagctgaaatgaaaggcgcatcttgcacaattacaaacatcggttctgccggcggacaatggttcactccggttatcaaccatccagaagttgcgattcttggtatcggacgcattgcagaaaaagcgattgttcgtgatggcgaaatcgtagcagctccagtcttagctctttctctcagcttcgaccaccgtatgatcgacggagcaactgcgcaaaatgcattaaatcacatcaagcgtttactgaacgatccacaattaattttaatggaggcgtaatgttatggtagtaggagatttccctattgaaacagatactcttgtaattggtgcgggacctggcggctatgtagctgccatccgcgctgcacagcttggacaaaaagtaacagtcgttgaaaaagcaactcttggaggcgtttgtctgaacgttggatgtatcccttcaaaagcgctgatcaatgcaggtcaccgttatgagaatgcaaaacattctgatgacatgggaatcactgctgagaatgtaacagttgatttcacaaaagttcaagaatggaaagcttctgttgtcaacaagcttactggcggtgtagcaggtcttcttaaaggcaacaaagtagatgttgtaaaaggtgaagcttactttgtagacagcaattcagttcgtgtgatggatgagaactctgctcaaacatacacgttcaaaaacgcaatcatcgctactggatctcgtcctatcgaattgccaaacttcaaatatagtgagcgtgtcctgaattcaactggcgctttggctcttaaagaaattcctaaaaagctcgttgttatcggcggcggatacatcggaactgaacttggaactgcgtatgctaacttcggtactgaacttgttattcttgaaggcggagatgaaattcttcctggcttcgaaaaacaaatgagttctcttgttacacgcagactgaagaaaaaaggcaacgttgaaatccatacaaacgcgatggctaaaggcgttgaagaaagaccagacggcgtaacagttactttcgaagtaaaaggcgaagaaaaaactgttgatgctgattacgtattgattacagtaggacgccgtccaaacactgatgagcttggtcttgagcaagtcggtatcgaaatgacggaccgcggtatcgtgaaaactgacaaacagtgccgcacaaacgtacctaacatttatgcaatcggtgatatcatcgaaggaccgccgcttgctcataaagcatcttatgaaggtaaaatcgctgcagaagctatcgctggagagcctgcagaaatcgattaccttggtattcctgcggttgttttctctgagcctgaacttgcatcagttggttacactgaagcacaggcgaaagaagaaggtcttgacattgttgctgctaaattcccatttgcagcaaacggccgcgcgctttctcttaacgaaacagacggcttcatgaagctgatcactcgtaaagaggacggtcttgtgatcggtgcacaaatcgccggagcaagtgcttctgatatgatttctgaattaagcttagcgattgaaggcggcatgactgctgaagatatcgcgatgacaattcacgctcacccaacattgggcgaaatcacaatggaagctgctgaagttgcaatcggaagtccgattcacatcgtaaaataattttcatatcaaaaacagccctcgctcaaagcggggctgtttttttattttgacagcacatgctgtaatggtttaatgatgtcttctttctttttcacacatccctcgattttaaccacgacatggcgctgatcaacaaccataagggtagggacagtttcaatctcatcttcccagccttcttttttatcatagaccttcattttatctatttgctcgggataatctttttctaaatcaagcagtgcatcgtaataaggcgcttcctggtctatttggttctcatcagaaaaaaacaggatttgtgtatgatgaatgttgtcaatccggctttttttcatcggattgatggtggaaagcgtacagcccgataaagcaaatactattatcagcatggggaataccgcgcgatatcgcatctatcttctcctctgtataaacagtagttaactagctttagtttatcacgagaggcggcttgatctgcttcttgttacctaattgttatataattgaaaccgtttttaaagtgagattacatattatatcaatcgtttaaaatagcaacctggggtatattgaattttttgctgcattcttggatgaaagttcaagaaaacgtgaaattacattatgtgctgtggcatatatatcgagtaaagcttctgtatgaagaagatattgtatgatggaaaatggaaaaacaaggtgaatatgatgagataaaataaaatgtgttatacagtttgttgttgacattttaaatgtgacatattaatataataacaacaaaagaaattaagcgttttcaaatttcaaagaaatggggaataagagatgggtacgattgtttgccaagattgcaacgaagccattcattactttgaagatgagaaagtgacaacattatacggaacatgctgcggacaatgtcaatgtcctgttgatgaagagtaaaaaaagcatgcggctttaagccgcatgctttttattttttattgaattgctttttgttctttgatgactcggatcatatgtaaagtcgagtcctcaggtccttgaacagggaggcctgcgtcaaggtttttaaaaatgtagctgatgttttcttctgtaataatttctcctggaatgaagattggaataccaggcggatataccatgacaaattcagcgataatccgtccggatgcttcttttaatgggatgacttccgtatttgcataaaaagcatcacgcggagtcattgccaataaaggtatttctggaagcagaacctcagtttgctgatgtgttacatcttgttctgacatttgctgtgcgatctcagttaaagcctctacaagccggtctgcatcattttggctgtcaccaggagtgaaaatacacaaaatattgtacagatcagaaagctcaacctcaatattaaaggattcacgaagccatttttccacgtcatgtcctgtcaggccaagacttttcacagagataatcaattttgtcggatcatagctgtaagctgctttcgacccaagaatctcagaaccgacacaataaatgccttcaatctgattgaggcgatctctcgtctgattggcaagcttgagtgtttcctcagcaagctggtggccttctgttgcaaggcgttttctggcaacatccaaagaagcgagaagcaagtaagaagttgacgtagttgtcagcatgctcaggatggattgcactctgtctttagatacaaggccttctctcatgtttaaaatagagctttgtgtcagtgatccgcccagtttgtggacacttgtcgctgctatgtccgctcctgcctgcatagccgatagcggcaattcgtcgtgaaaatgaatgtgaacgccgtgtgcttcatccacaagcactggcacatcaaacgaatgagcgagttctacgatgctttttaagtcggctgcaacaccgaaatatgtcgggttgatgacgagaagcccttttgcatccggatgttcggtaagcgcccgtttagcagattcaagtgtaatgccgtgggagatgcccaactcattgtcaatttcaggatgaataaaaattggaaccgctccggaaaatacaatagctgtcataattgatttatgaacatttcttggaataataattttatcgccaggtccgcaaacagccattaccattgtcataatggcgccgcttgttccttgaacagaaaaaaatgtgtgatccgcgccaaatgcttcagcagccagatcttgtgcttgtttaataatgccttttggcgcgtgcagatcgtctaatggttcaatattaatcaaatctatgcttaacgcgttttcaccgataaattgtctgaattctgggtccattcctgccccttttttatggccgggaatgtggaattgaacaggctgtctgcttgcatgctttttcagtcctgtgtataagggtgtttcatgttgcgacaattgttttcccacctttgtaatcatacctatgcataatagtgtgtattaaaatcagtttctcaaccgttttttagacgtaaaacaaatgaattatattatgaacttgaaagaatgtaaagaacaatttatgatcaaatgaagatgctttctcttaagggaagtaaatctacaaggagtgaagaaaatggagtatcaatatccgatgaatgaagattggacaaccgaagaagcagtggatgtgattgcatttttccagcaggttgagcttgcatatgaaaaaggggcggatcgtgaacaactgcttaaagcttaccgccgtttcaaggaaattgtaccggggaaggccgaggaaaaaaagctatgtggcgagtttgaggaacaaagtacatattctccttatcgcacggtcaaacaggcgaaagaatctgatcaggcgaagattaagatgtaggaaaaagagccggggatgtcccggctcttttttatgcttgtgatactttttgggtaagacggtacagaaaagcaagctgcttaaaggcatcgtcgatacgctgaaggaattcctggttattcatattcagcacttcttctttttggagctggatgccgcataacagctcggctttctttacagtctgcaaacgctcaaacagtgtcttcagctgttccttgtccatttcagactgtttatgtactcccggttttgtgtgatctgcagaccaaacgaagctgtcagggatatttttcgtaatggtttcttggttcacttcaagcaatttgccgtattcttctttgataggggattcataaataatcgcgaaccatacaaagacgtggctttcccataaaccaatttggaaatgcggcagttttttatagcctcttttgctgtttgcgaacgccacccagctgtcagccggggattgacggatcttcttgcgtgcttcgccacatgcggaaacatttcatctccggttaaagctgataaagttggggcaaaatgttcgcctagagctgtaagcttcggacggaccgtctcttttaatacttccatgcgcgcgtctaagccttctattgtaaatgtgttaaagtcttcttcagtgaaacgcatttgtgtcatgattttcctccttcatgctaagtatacatattttatcacagttcatacgagcttcaaaaagattgagcgcgtttgaagtaaggggaaatgtggtaataaacgagtaggtaaacacacaattttcagaatcatgttgcgcgtaaatagaacaatcatacgatataagaagtaatcattgttgaatggcaaaatgggatgcttttttacaaacaaatgatctctggaaggggcgaaagacaatgaggcaagttgtaaaagagggatttaaggaagagaaaaacaatcgtgttgctgtctggagactagaggttgattatgaattggcaaccctatatgaagcaatgcagaaagaaaatgaagagcagattgaacaaagcaaaaacaaacttgagcgacttagaaaagaatggattcgtcttaacgggtaaaaaagcgatagtgaaaacgaaccgcatgaatggttcgtttttacgtgagaagggatatttttcattttccttgctttttcattgccgttatcagtatcctataaaataaaaggtctacatagaagagaggtacgaacgaatgacaaattggacggaaattgatgagattgcaaagaaatggataagagaagcaggcgcgagaattaaacaatccatgcatgaaagcctgacaattgaaacgaaatcaaatccgaatgatttagtcaccaatattgacaaagaaaccgaaaagtttttcattgatcgaattcaagaaacatttccgggacatcggatactcggtgaagaggggcaaggagacaaaatccactcacttgagggagtcgtatggattattgatccgattgatgggacgatgaattttgtgcaccagcaaagaaattttgcgatttccattgggatttttgaaaacggtgaagggaaaatcggtttaatttatgatgtggtgcacgatgagttgtatcacgcatttagcggcagaggagcttatatgaatgaaacgaagctggctccattaaaagaaaccgtcattgaagaagcgatacttgccattaatgcaacatgggtaacggaaaacagaagaattgatcaaagtgtgttagcgccacttgtgaaaagagtcagaggcacacgctcctacggttctgccgctttagagctggcaaatgtcgcggcaggaagaatagatgcttacatcacgatgcggcttgcgccatgggactacgcagccggctgtgtgctgttaaatgaagtaggaggcacctatacgaccattgaaggagagccgtttacctttttagaaaaccacagtgtgctagccggaaacccatctatacataaaacgatatttgaagagtatcttcatgctcggaagtaggccatttgagcaggatgatctcagcttgttagaaaagctcgcggaggctcatcctgtatggaaagaggaggagtttggagataaagatgcagaagactatatcatttcctactccatgtacaacggttcatggcttgtatgggaaaaagacggtatgcctgttgccgtcagctaccatctcgagtggtctccttcaaacggtaagccgtggctcggaacggtcctgattgacccggttgaagaaaaaaagggcatgcgaagatgatcattgaacagatcagcaaattgcttagagcgaaacataaagcgatgtttgcgggagttcccattgagcgcagggaatggatactgtttttaagccaatgcggctttgaacagctgaaaacggaaaaagatgagaaaggcaaatcatttatgatcctggtgaagcctttagcagaagctgccatatgataatggcagcttatttgctgcatgcgggttcaataaaaagcctctcaaacattgagaggcttctgataatttgaaaattatttttttaccgcatgaatataatgaatcgtttcaaacgctgacaaattgtcttttcgattactaaagaaaaggtcattaatgtcgtctggtgatagatgttcatagatcagtaaaccagatgactctaacagatgttcaatctcttgataagtgaaacatgatttcatcggttccccgcttgcggcagccatcttcaccatatgttcaactcgatttgacgtcccttttgctgtaaaaagtgtttcgtccgcataatcaaaaacaatagagcttccaggcgggacatgagaaaataaattactgatcaagcttgcattttcttcccgtgttacataataagacactccgagaaggctgaagaatgtttttgtgtttttaaatccttcttctaagagaggatcatacgaaaacgttttggtgaaatccataggaacaaaatgaagatgacccggaattgtcagatttgcatccttcagcttattttttttgaattgctgtgtagccggatgatcaacctcgaaaacctgtaagctgttttctaattctggatgccgaaagcagaaagtatccagacccgctccaagaatgacatactgttttgcccccaggattaattcgttgtgcaagactttttcacaataagaagcacgtgctaggggcgtgggagacagctggatttgtgcaacccattttaatattttttcaggatcattttgaagacgttcggcgatctctttgttgaaaaacgatattccttgaatcatatttttactgatgtcgataaactctttttcgttaatgagatcttttgcgataaaatcatcaaaaataagaggtgtgtcatatcggctgtgatatgcacgggcaaaagctgaaattagagacgttaagctgggctcatttttcctcatgaaatgatcctccacaaaaaataagattcccctggccaggagaatcttattatacatacaaatatattaatagtaaattttagcataaataaatttttttgtcaatgtttttgctcttaactggacgcgcgatccttcacatagccacgtgacctgtagcagaattcgtctatcaattatgtggactgaatcattagcttttataaaatgcgcacttgtggctgcatccctcttttgcaaatcaggagcggtttctgtctcatggcagcatcttttcgtcgtttctgctgagagagaaatcaagatatgtaacaaaaaaagcctgagggatctcaggctttttctaatattacaatccaacagcattccaggctgcttcaactttagcggcatcagttgagccgtagaggtcacgggcagactgaatgagagctgccttggcatctttgaacgtggaagaaggcgtgaggtacgttgttaacgcacggtaatagatttgctgtgatttagatacaccaagttttgtgatggtgttgtaagcggctttgtttggaattccgctgtttgtgtgtacaccgccataatcgccttcatctgtgtttggaaggtttctgtaattggcgtaattgtcaggctggttgtattttgtagggttggacaggctgcgaagagcaggctggctgaccgtaatgtcttcaccgatgtcccagtcttctgtatcgttaaaatacccgaatacgtcagagaaagactcgtttaatgcacctggctgattttcataaatcaagttggctgtttcttgggtgacgccatgtgtcatttcatgcgctgtcacatctaatgagccggaaagcggagagaagaatgaaccgtcgccatcaccgtaaatcatctggtctcctgtccatgcagcgttattgtattgagtgccatagtgaacggaagaaacgattttactgcctttgttatcatagctgtttcgtttaaagtttgaataaaaataatcgtacactttaccgaggttatagtgtgcgtcaacggctgcccgctgtgatgaagatgtaaatgttttcgttgtgcttgagacaagcgttcccggaaggcggctttgtctgttttgcaagtcatatgtgatgatttgggtgccagttggttttgaaagatctcttagaacatattttccgccttcataagagatgttcaatggaacagttgcgccctttagagttgttccgcttccagtggcggcggcatgttctactttattttgctgttttaaaatgctgcctgtttcggcgtcaactaagacttcccagtttgcaggttcaggctcgacatagcgaatcgtcacgtcgtaagcaagacgatagctgccgtcttttgtttctatcgctttcaattcggctttattgctgtttttggccgctccgttagaaacagcgtctggtgatttgccgatagctttgaaagcgagtgccagcgctttttcagaagagactttttggctgttatctgtttttgcagcagattgattgtgtaattcaccattgaccgcatagacattatcggatttatcgacgtgaacgatcacttgcgaatctttaattggcactccgttaacgacaggcgcatatcgaaagtgcttgtacccaagggcatcagtcgtgctttcaacaagcttcagccttttggaaggatcacctttaaaaatgttgctgttctttttcaaaaactgcttgacagccttgtcatttggtgcagagagttctgattgcgcaatcgcatttttggagaggaaatttgtttgattctctttaagctgatgaccttcagcagcctgaacacctggcaggctgattgataaactcataaacgaagcagcgacagcaacagacaatttcttacctaaacccacaataaatccccctttttgaaaatactgaaaactttatattgttatattaaactagcattctggaatactcaacaaaaactaacataactagacaaaattgatagtattgtcctgtgtttgtttttgttgaataatatcaagatgagtcaagtgtcatgtggtggttcattcaagagttatgttttttgcatatcaaggggaagatgagatatttttgtttcatcttgaaactttttgaaaagtccgctgtctaaccgaatgaggccttaataagaagtaaaggattgttgttcgtgttggagttattcagtcattatgtattgcatttcgaacgttattttatattaagcagacaaagcaccctgctgattcaatggtcaattgttgttctggcgggcttatatcttttggtgcatcatcccaaaatgaaccggcagcgcacaatgttcttggcgggtgttatattgcggattgtgctgctggcgggagtgtctgttgaacttattcaccaggtgcaatcaacaaacttcaccagcgcttacttaagagaggacggaaaagaactgctgccgctgctgcattttttgttatacggatttgtgctgctgacggcttttcactatatgctgatgccgcgtgatcatggcggaaagggtatgttttatacgttcgacctcgccgttgtcagtttgccgatcgtacaaatgatttttagtttcttttcgtattggaaggaatacccggatgggatggagccgattgcattcgtgtttctgtttttcatcatcactcttcccattgcgttgaatgtagtgtttttcaagctgtattggagaacggataagatcttactaggcttattttatacgctgattatcggactgcttgtcttgctgcttgcgccatatcccaatcaaatctcaaaaaattatggtgcagtaatgccatatacgatttatttggcaatggcgggatttttgatgagctatcatctgttccaaaagtcaggaaaggtttatgtgcgtgtgaataagtgggtgacgatggctgttctggtgttttttgtcctgctgttaaatccgatatataacataggaacggctgctttcgctgtatcaaagccagcaaatgtccatgattcattcaattttgtcggggagcacatttcatcagaaaaagcggaacagatactaaagtcattttttcctacggatgaaacactttatttgcacgatacaaacatggatgtgcattatttctactcatttgaaagcaaaggttataaagctgaggtagatgaagtatcgcaactgattcgtaattatgaatacttacaaaaagcacatgggaaaaagctaacgaatcaggagtacaagcgaaagtccatcgctttccttgagcgacacggacgtgtgttacataaggatcatatcgaaacaaaggtatctcaagaagacggccagacagtcgtacgtatttacctgaaaaatcaacttcataaaaaagatcctgctgatgatggcacggtattttattgggaaaaggaaaccttaatggggtttagtgaagatccttcgatttatcagcttgactctcttctgcatgttcatataacagaacaagacattcatgacaaagtggaacaaatgtttacagcactgaacatctcaaaacagccttatcagatcactgatattgaaagcaatagcctgctcggaagcatggtgagagtggaaacaaaaggtggaattgttttggaatttgagggcgaatccggttgtttacatagtctttcgcttccgatgaaaaagaatatctcaatggctaacagccggctgcagcatcagatattatcgatcttcgatgctcgtggatcagaaaagaagaaaaaaagcagtcagggtgacatggtgatgtatactgattcttctaaaacatatgagttttttgaagatcaaggtcagctaaacgtttatgtatacagcgatacacctgatcagtcattcccctatacatatcgtaatggaacattggcttacgaaaaagtagcttctctatatcaggatgtcatttacaaaaagcgtatgcgcccgattatcgttcaaagaggggatgaacggcattatgcatggctgatcattattcagccgtttggttcaaatcgccatgatgcctatgtagtggatggagaaacacaagaggtgaaaagtctttatgaatcataaagaaaaagagtctgtttttgtagacctatacgacctgtataaagaaggagagctagaggatgaatcaatggaatggatgaaacagcatgaatcccaattccaaaagaatgcggaagacttaaagagtaaaacttgtttaaagagaagtcccggtgctgaagaagaaagccaaatcagatatatgaaagtatacctgtcttccatgtatatctgtttcattttattggccatttggatgacggtgtggttttacttttaatgaagcatagggattccattgaggagttgtatcgacagtattatcaagaaattttaaattatttattcagaaggactcatcatcttgaaacagccaaggacttagcgcaggacacgtttgtgaaagctcttaacggtctggcttcgtttagggggcattcttccatcagaacatggctctacaccattgcgcatcatacctttatcaattggtaccgcagggatgtcaaataccaatttactgatatcagcaaaaatgaagggttaacgcaaacaacttatgagcagcctgaacagtatctgtcacggacggtgaaaagcgaaacactgcggcaggagctcctgaagttaaaaaatcagcatcaatccgttttgattttaagagaattccaagagctttcttatgaagaaatcgctgagatattaggttggagtctttctaaggtgaaaaccacattgcaccgggctagattagagctaaagaaaaacatgacgaaaagtagagaggaggagcggatatgacctgctttctagtaagagacctgcttcctctgtatcttgaaggtgattgtaaaagagaaacggaacacgttatagaagagcatttaaaaatgtgcagcagctgcagagacatgtatgacacgatggctgagccatttgaattggaaagcgaacaggccgttgaggaggcttttctgccggaagaagaactgcgttttaaacagaggtactatggattactgattatgaaagccgcctgctggtttggagcggcggttgccgtgatgctgatcatcaaactgctgatataaaaaaaagcgcttgtccgattccggcaagcgctttttcacattaagcctggggatgaatcatatcgtaaatagcggcaagctgttcttgtgacagggcactgaagagtttttcataaacgtcagcttgcagtggcgttgcacctgcttgtagcgctgcgtctttatcatagctgtacacatcatcttgtagcacaatggctgcttgaagaatgtgaatcttgagagaaacagcggagaaaaattgttcaagtgcaagtgcttctttttctgtgaagccaagttcaactgctttttctgtatcaaatttgtaatttccatcctcgagatacacacattgtgaaacaatgctgaaaaattctgatgtcgattcccagagtgtagcaattacctgagcctcttcttttgtcattcctaactcgacagctttttcgctgtcaaaataatatacaccgtcttgttcgtatatacattgatttaatatatcaatgaatgtattgagatcttcattagtgctcgcctgatgctggagttgaacagcagtgttatcaaccagtgtttttgcgctggctgcatcaggaccgaacgttaatagagcagctgaggttattgcggcagtcgttaacatagctttttttacaaatgttttcttcatgtttcttctctcccttttgtgaattgtgctacaaattccattatagggagtagtttccggtggaggaataggcgctatggtattttatgcgtatcgttgccgaactactttttgaaggctgcacgtgtgaccgttagaacgattgtctatgtatgtaggctgttttgcatcttcctgactaagaaacaggggagataaggcttaaagaaatgaaaaacaccgctttctttgcggtgttttttgattacaatgtcgccggcggggcaatgcttttaatcaagcaagccttgttcgcgcattttcttttttaatgtaaatccgccgcccatgacagcgcaaacaagtacaatgctggcgataatgcctgcagggcttttttcagcgataaagacgccgatcagcataatgctgaaaaccgctgcaaatgcaaataatagtaaaagccaattcatttttttcataatttccatccccttttacgtcttatattaagtttacagaaaaacgtgacgcttttaaagaggatgtgtgatataatatgaaagttatctaatttttttaggagatgaaaaagtgaaacttcgaaatgatcttcgcaacatcgcgattattgcccacgttgaccatgggaaaacgactctagtcgatcagcttttacatcaggctggtacgttccgtgccaacgaacaggttgctgaacgcgcaatggactctaatgatcttgaacgcgaacgcggcattacaatattggcgaaaaatactgcgattaactataaagatacacgtatcaatattttggacacccctggacacgcagactttggggagaagtagaacggattatgaaaatggttgacggcgtagtgcttgtcgttgacgcatatgaaggctgtatgcctcaaactcgttttgttctgaaaaaagctcttgagcaaaacctgaaccctgttgttgttgtaaacaaaattgaccgtgactttgctcgtccagaggaagttatcgatgaagttctggatctgttcattgagcttgatgctaatgaagagcagctcgagttcccagtggtatatgcttccgcgattaatggaacagcgagtcttgatccgaaacaacaggatgaaaacatggaagctttatatgaaaccattattaagcatgttccggcacctgttgataatgcagaggagccgcttcaattccaagttgcccttcttgactacaacgactatgtaggccgtatcggaattggacgcgtattccgcggcacaatgaaagtcggacagcaggtttctcttatgaagcttgacggaacggcaaagtcattccgtgttacaaagatttttggtttccaaggcttaaagcgtgtggaaattgaagaagcaaaagcgggagacctcgttgcggtttccgggatggaagatatcaacgttggtgaaacggtatgtcctgtagaccatcaagatccgcttccggtgcttcgcattgatgagccgacacttcaaatgacatttgtcgtgaataacagtccgtttgcaggccgtgaaggcaaatatgtaacggcccgcaaaatcgaagagcgtcttcaatcacagcttcagacggatgtgagcttgcgtgttgagccaacagcttctcctgatgcttgggttgtttcaggacgcggtgagctgcacttgtcaattttaattgaaaatatgcgtcgtgagggctatgagcttcaagtgtcaaaacctgaagttattatcaaagaaatcgacggcgtacgctgtgagcctgttgaacgtgtgcaaattgatgttcctgaagagcatactggctctgtcatggaatcaatgggtgcccgcaaaggcgaaatggttgatatgatcaacaacggaaacggccaagtccgtctcatctttacagtcccttcccgcggattgatcggttactctacagaattcctatcattaacacgcggattcggtattttgaaccatacgtttgacagctaccagccgatgcaggcaggccaagtcggcggacgccgtcaaggtgtacttgtgtcaatggaaaacggaaaagcaacatcatacggtattcaaggaattgaagaccgcggtgtcatcttcgttgagccgggtactgaagtatacgaaggaatgatcgttggagagcataaccgtgacaacgaccttgttgttaacgtcagcaaaatgaaacagcaaacaaacgtccgttctgcaacaaaggatcagacaactacaattaaaaaagcgcgcatcatgtctcttgaggagtctctagagtacttaaacgaagatgaatattgtgaagtaacacctgaatccatccgtttaagaaagaagatcctcaataagaacgaacgtgaaaaagcagctaaaaagaaaaaaacagcaggattgtcttaatctcgtgcagaatttgaaaagatagaacccgtacgtttacaggggagggaatctttttgaatgacgtaagcgaacgcctgtcgttcttcgccgctctatatcaagtagaccggcagcctgcggcaggcatgtggctgctgtacggcacgatttttgtgttggccgttattgtatttaagcttggatttgctaaacggcttcctgtattaaaatctgcagtggtgtatgtatttttggctttgggctgcactgttttgacttttttaggggtgtttttgcccgtggcagaaggattggtcgtcgctgcgctgattttaatcatttacaaaatccggctgtatcagtcgaaaaaaggacagtctgcaaaatcataaaagactcagctgaaagctgagtcttttttgtgttctgtatggttaagcggccgctttattttttgactttttcttttttctgctgtcccgggtgaaaagtaaattttcccgttttcagccgttcctctgtttttttggcaatccgatcgtggcattcctggcacatatatgtatggatcgggcggtttcgaagccgtttcgcgatcagggtatcatcatcaattgtttcaattttatcgcaaatagaacatttgaccctcatcatatcacctctttcactaacatgtattataccacggatcagaagctgtccaaaataagaaaaagctaaagcgcaaggctatagcttagtcattgttgttctttttcatatgatgatcagattgatcgttttgctccttctccatttcctgttgatgttttctatttaattggtcattttgctgctttgtttgcggttcgtcttcattgtcaatcacatcgttaggcacttcgggaagcactcggccgacaattgcagctaattcatccagtatacctgttaccggatggccctcgctgatttctctgctcatttcgcgaaggcggctgaccgtatcgggatcagcaatgactactgcgttggcgccatatcgatcattctttagcgcctgagctacagaatatttaatggtttccactttgcttctgtccaaagtatcatcgacatcaatcccaacaacagcatagcctcccagcacaacggctgttgcatccttgacgtcggggtttttttcagcaacgctgacaagatgcttggcaatatccgttcttgttccattgtcttttgtttcttgagttgtgtcctttacgtgaatcggtttagtctcctgctgtcttgttgattctttttcaacattctggccctgttttccttgttgataggcacaagcggacaggataagtgtcagctgtatgataatgaaaagaattcgcacttgcgggttccctccttgaaatgctttcattaattttattgttgaattaaccttctatctttatgcacaaaaacatatattttagcaggcattcacctttttcatcaaaagagaagcaggaagaactttgacccttatatcaggaggctgagacttgagtaaaatttatgtgttagatacgaatgtgttattacaggatcctaacgcgatattttcttttgaagaaaatgaggttgtcatccctgctgtcgttttagaagaggttgattcaaaaaaacggtatatggacgaagttgggaggaatgcaaggcacgtatctaagctaatcgatgcgctaagacaaaagggcaggctgcatgagcatgtaccgcttgacaccggcggcacactgagaattgaactgaatcatcgttcgtttcaccagctgcaagagatctttattgaaaagacgaacgataatcgcatattagccgttgcgaaaaacttaagcctcgaggaagaaaccaaggaaaatggcaggccggttatcctcgtcagtaaggatgtactggtcagggttaaagccgacgcaatcggactgcttgctgaagatttcttgaatgaccgggttgtggacaatgatgaaatgtacagcggctataaagatttatatatcagccagcagctgttcagctctttttacgggaaaaatcaaatttcagtaaacgatgtgaaacagcatgcgttttatccgaatcagtttgctttaatgaaggatgagctaggaggatcctcctcggcaatcggaattgcagataaaaccggaacggtattaaaaagactcgtatttgatgatgaacatatatggggaatcaggccgaaaaatgtacagcagacaatggcattagagcttttgctgcgggaagatattccgcttgtcaccctgatcggcaaagcgggaaccggcaaaacgctcttagctttggcggcagggctattacagacagaagacttgggaatatataaaaagctggttgtcgcaaggccgattgttcctgttggcaaggacatcgggtatttgccaggcgaaaaagaggaaaagctaaagccttggatgcagccgatttttgacaacttagagtttctgtttaatgcgaaaaaaccaggggagcttgatgctattttggcgggaattggctcaattcaggtagaggcgctgacttatatcagagggagaagcattccagatcaatttattatcattgatgaagcgcaaaatttgaccaggcatgaggtgaaaactttgctgacgagagtcggtgagggcagtaaaattgtcttaatgggtgaccctgaacaaattgatcacccatatttagacagtctgaacaatggtttagcctatgtggttgagcggtttaaaggacaacccatctcaggcagcgtgaagctgttaaaaggtgagagatcaggtctcgcccagctcgcagctgatttgctgtaacattaaataatttcgatctcttttacgtcggtaatcggctgtttgtgatgaatcgggtcttcaaagtaaatatgcacggggccgccttcttgaatcggcttgcctgcctcactgaaatggacaatactgttcagagcggtttccagagaaacggcggcctttcccgaacttgtgacaaatacacattgtgtcgcagagctgttcggctcagcatttttcaggacagtcccaagtctcattgcgaaactgccgttcatcagtttttgcttctcatattgtttttccgtctttaatgtaggcggcgcaattcgcccctctctgatgacgcgttccggatcaaggtcggattcatccccggctgattgtaaatatgtgtcttgactgtcccctttgcggtcaaacgaaaatttgcgatcatcaaaaatccatacgcttggatcaatggtaattggatatgtaacattgccttttacttggataacgctcatgatatgacccccttctctcaaaattataaaagttttcgcatgaattgtcactttgtgtacaaattatgtgtattgaaatgctgagggaacgagggtgtttgcatggtatgccggcataatgatgagcttgaagccttagtgaaaaaggcgaaaaaagtaacggacaagggggaggtagccagctatattcccgccttggcaaaagctgataaacacgacctgtcagtggcgatttattattccaataatgtttgtctgtcagcaggtgacgtagaaaaaacatttacgcttcaaagtatatcgaaagtcctttcccttgctttggtgttaatggaatacggcaaagataaggtcttcagttatgttggacaggagccgaccggtgatccgtttaattcaattatcaagctcgaaacagtgaatccgagcaagccgttaaaccctatgattaatgccggggcattggtagtgacaagtctgataagaggaagaacggtgaaagagagacttgattatttgctttcttttatcagaaggctgacaaacaaccaagagattacatactgccgggaagtggctgaatctgaatacagcacttcaatgattaatcgggcgatgtgttattatatgaagcagtacggcatttttgaagatgatgtagaagcagtaatggatttatatacgaagcaatgcgcgattgagatgaacagcttggatttagcgaaaatcggatctgtatttgcattgaacggcagacatccagagactggggagcaagtcatctcaaaagatgtcgctagaatttgcaaaacgtttatggtgacgtgcggaatgtacaatgcaagcggggaattcgcaattaaggtcggaattcctgcgaaaagcggcgtatccggcgggattatgggcatttcgccttacgatttcgggatcggcatattcggccccgcattagacgaaaaagggaacagcattgcaggtgtaaagcttttggaaataatgtctgagatgtacaggctgagtattttttaatttatgtcatatgcttaaatcctcttgcattttctgttgataccctttatgataaatagaagaattaggtactcgcctggggaacggagggatacttttggcttcagagatgatagttgaccatcggcaaaaagcttttgaactcttaaaagtggacgctgagaagattttgaagctgatccgagtacaaatggataacttaacgatgcctcaatgtcctctatatgaagaggttttagatactcaaatgttcgggctttcgagggaaatcgattttgctgtccgcctgggattggttgatgaaaaagacggtaaagaccttttatacacattggaacgcgaattgtctgctttacatgacgcgtttacagctaaataaatgataaaactcaaacttattaacagtttgggtttttttataaccgctatttttctctcatctcataaaagacggtctttttttacacattccttccgaatcgtatagagattcttcgtctcgtttgataaattgtagtaaaataaaaaagataaatacataaaaaccatagataatggaagttagaagcagggaagaggatgttatgttaaaaaaaatgctaaaatcttatgattactcactgatattcgcaatcgttttattatgcggattcggtttagtgatggtatacagctcaagcatgattacggctgtctcccggtatggagtaagcagtaattttttcttcatgcggcagctgtttgctttaattgcgggtggcgctctatttattctcatggcgttgtttccttataaagcactggcccatcaaaggtttcagaaggggatactgcttgtatctgttcttgcgcttatctcactgtttgtattcgggcatgttgccggaaacgcgcaaagctggtttaaaatcggcggaatgagtattcagccggggagtttgtgaaactggtcgtgattttatacctcgcagccgtatatgcaaaaaaacaaagctatattgaccatctattaacgggtgtagctcctcccgtagtcatgacgcttgtgatttgcgggttaattgccatgcagcctgatttcggtacagccatgattatagggctgattgcgacgtgcatgatcttgtgctccggcttcagcggaaagacgctggtgaggctgcttttgctcggcggaattgttttcattttagtcagcccgattctctatttaaatcaggatcaaattttaactaaaggccgtttggcgcgttttgagagtcttgaagacccatttaagtatgcaaattcatcaggtttgcaagtgatcaattcttattatgcgatcagctcaggcggcattttcggcctggggctcggtgaaagtatccaaaaatacggatatctgcctgaatcacacactgactttattatggctgtcattgctgaagagctcggcatttttggggttttgtttgtgattttcctattgggttttgtcgtcattaaaggtttttatatagccagaaagtgcgaggacccgtttggaagtcttctggcgatcggcatttcaagtatgattgccatccagtcgtttattaaccttggcggtgtcagcggattaattccgattacaggggttacgctgccatttatcagttacgggggctcttctttggtgctgctgctggggagtatggggatattagcgaatatcagcatgtttgtgaaatattcagagaataagaaaaagaaagagcccttggcgccgaagggaatgaaaaagaaacagctcaaaaaaactgtttatcagtaaaaaacaagtgtgtacaggggaaggatattccgctatgatagattatattccattcgggtaagggggagaaaagtttgtctcagcaatcgatacaaaaagtattagtagcaaacaggggagaaattgcaatccgaatattccgggcgtgtaccgagttgaatattcgtacagttgcggtctattcaaaagaagattccggttcctaccatcggtacaaagcggatgaagcatacttggtcggtgaagggaaaaaaccgattgatgcttacctggatattgaaggtatcattgatattgcgaaaagaaacaaagtcgatgcaattcatccgggatacggtttcttatctgaaaatattcattttgcgagacgatgtgaagaagaaggcatcgtattcatagggccaaaatccgagcatctcgatatgtttggtgacaaggtaaaagcgcgtgagcaggcagaaaaagcgggaatccccgtgattccgggaagcgacggtcctgccgaaacgcttgaagccgtcgaacaatttggacaagctaacggttatccgatcatcattaaagcctcgcttggcggcggcggccgcggtatgcggattgtcagatctgaaagtgaagtcaaagaagcatatgagcgtgctaaatcagaggcgaaagcagcctttggcaatgatgaagtttatgtagaaaaattaattgagaatccaaaacatattgaggttcaggtcattggagacaagcagggcaatgtcgtccatctttttgagagggattgttccgttcaaagacgccatcaaaaggtcattgaagtggcgccgagtgtctcgctgtcacctgaattaagggaccaaatttgtgaggcggcagttgcgcttgccaaaaatgtaaactatataaatgcggggacggtcgaattccttgttgcaaacaacgagttttactttattgaagtaaaccctcgcgtacaagttgaacacacgataacagaaatgattactggtgtcgatattgttcagactcagatccttgttgcccaagggcacagccttcacagcaaaaaagtaaatattcctgagcaaaaggacatttttacaatcggctatgccattcagtcacgggttacgactgaggatccgcaaaatgatttcatgcctgatacaggaaaaatcatggcttaccgctcaggcggcggttttggtgtccgtcttgataccggaaacagcttccagggtgccgtgatcacaccatactatgattcacttctcgttaagctttcaacttgggctttaacgtttgaacaggcagctgccaaaatggtgcgaaaccttcaggagttcagaatcagaggcataaaaacgaacattccgttccttgagaacgttgcaaaacatgagaagttcctgacagggcaatatgatacgtctttcattgatacaacgcctgaattatttaatttccctaaacaaaaagaccgcggaacgaaaatgctcacttacatcggcaatgtgacagtaaacggcttccccggaatcgggaaaaaagaaaaaccggcgtttgacaaaccgttaagcgtaaaggtagacgttgatcagcagcctgccaaaggaacaaagcaaattctcgatgaaaaaggtgcagaagggcttgcaaattgggttaaggagcagaaatctgtccttttaactgatacgacattcagggatgcccaccaatcgttattggcaactagaatcagatcgcatgatttgaaaaaaatcgcaaatccgacggctgcgttatggcctgaactattcagtatggaaatgtggggaggcgcgaccttcgatgtagcctaccgattcctgaaagaagatccgtggaagcgtttggaagatcttcgcaaagaagtgccgaataccttattccagatgctgcttcgctcatcaaatgcggtcggctatacgaattatccggacaatgtgattaaagaatttgtgaagcaatcagctcaatccggtattgatgtgtttcgtattttcgacagcttaaactgggtaaaagggatgacgttagccattgatgccgttcgggataccggcaaagtggcagaagctgcgatttgttatacgggagatatccttgacaagaaccggacgaagtacgatcttgcttattatacatcgatggcgaaggagcttgaggcggccggagcccatattctcgggattaaagatatggcagggctgttaaaaccgcaggctgcatatgaacttgtttctgcgttgaaagaaacgatcgacattccggttcaccttcatacgcatgatacgagcggaaacggtatttatatgtatgcgaaagctgttgaagccggcgttgatatcatagacgtggcggtcagctcaatggcgggattaacgtcacagcctagcgcgagcggattttatcatgcgatggaaggcaacgaccgccgtccggaaatgaatgtccaaggcgttgaattgctgtcccaatattgggagtcggtgcgtaaatattatagtgaatttgaaagcggaatgaagtctccgcatactgaaatttatgagcacgaaatgccagggggcaatacagcaacctgcagcagcaagccaagggagtaggccttggcgaccgctggaacgaagtcaaggaaatgtacagacgcgtgaacgatatgttcggtgacatcgtcaaggtaacgccttcctcaaaagtagtcggagatatggcactctacatggtgcaaaacaatctgactgaaaaagacgtttacgaaaaaggcgaatctttagatttccctgattctgtcgtggagcttttcaaaggaaatatcggccagcctcatggcggattcccggaaaaactgcaaaagctgatcttaaaagggcaggagccgattacagtcagaccgggcgaactgcttgagccggtgtcatttgaagcgatcaaacaggaatttaaagagcagcataacttggaaatttcagatcaggatgctgtggcgtatgccctttatcctaaagtcttcactgattatgtgaaaacgacagaaagctacggagacatttcggtattagatacaccgacattcttctacggtatgacattaggtgaagagatagaagttgaaattgagcgcggcaaaacgctgatcgttaagctgatttcaatcggtgagcctcagcctgacgccactcgcgtcgtttatttcgaactgaacgggcagccgcgtgaagtagtcattaaagatgaaagcattaagtcttccgttcaggaaaggctgaaagcagaccggacaaatccaagccacatcgcagcttccatgcctggaaccgttattaaggtattggctgaagcaggcacaaaagtcaataaaggtgatcatttgatgattaatgaagcgatgaaaatggaaacaacggttcaggcgcctttctcaggaacaatcaagcaggttcatgtgaaaaatggcgagccgatccaaacgggagatctgcttctcgaaattgaaaaagcataaaaaaaacaagagtgtatatcaatgatatacactcttgttttttatatagaaaatgtggagtgaaacagatggttagaagagatataaggggacttcagagattatagagtactgtcacaagcccaaaataaaaagaggcttatataccaccaattttttagatgctttgtagtagtccatgcatatttctttaagcactatctgattttccaatggccaaaaggctttaatacttatgttcgcggactacatatgaaatttctataatacgatgagaaagggacagactgaagtgagccgctcactgatcatcaagttcagcgaaggctggccattgaaacaataaagcgccaaaacaagacatgaaaaaagaccaaagccgcctaaggctttggtcttgagtccttatgattgcctggattcataacggaaacgagcaatcaataataagaagtagcatagaacgccaaacagacaggcaataaagaacgagtgggcaagtgcaaagcccagagccagttcagagtatacgatcataataccggacagtgcctgtaatgtaatgaaaataagacatgagatccatccccaaaagatctgtttttgatctttataggaagtaatagcatgaacagcggcaacaataatccatacaaataacagtaaggctgctgctctgtggcccatttgcacccattcatggaattgggtcggaagtccattgttcagcgggctgcacagcggcacatcaggacatgccagacttgattcagtgtgtcttacatatgcgcctgtatacacaacgatataggaatatatcaaaattcctatcatgtgaaattgcatctttttgccgatttgaagcggcttaaccagtgttctgactgatttatcagcttcaaatatgagcaatgttaaaataagcactgaagcaaaagaaattaatgagatgccgaagtgaagtgccataatcagcgcgttcgaaccgaatacgacagccaatgcgccaagcaatgcctgaagaaataaaaagataattgacatgatcgcgagaaacgttgtttcacgaaaaatcggcgtgatttttctccatgaccaaaacgcaaggcttagcacaaggataatagagattccgcttgcgaatcggtggctccattcaataattgaagccggattcagttcagggaaaaaacggccgtgacacagcggccactgtctgccgcatccttggccggaacctgtttttgtaacgagggcacccccgattaaaacaattagcatgacaaatgtcgtcagaacaccgagagcttttaatgctttattcatacaatattcaccttcttaacatactgctgcaattttatatacgttccaagtgtaagcgaatatgtgttttgtggcaattcccagagccttttgttcacaaaaatataatagaatgacggcttctggaaaatgtacacttgattattcatgccgggtctgatagaaataaggtaaacgcaatgccgatttggagattgccttcatctttggtaaaattcataaaaagttcacaaataaattcctgtttgtcgtttaatatttaataggatgtttttttacaagatgttatcttgtatgatagagttgcaggttattttattctcctgcgttaggtttgtaagggaggtttacgttatggctaactccagaatcttaaatgatacagctatagacggacaaattgaagaaacaacggcatggaaagattttctgtcccttattaaaatagggatcgtcaattctaacctcatcacgactttcactggaatgtggcttgcactgcatatatccggtttaagttttttaggcaatataaacaccgttcttcttacgttaatcgggtcttcactgattattgcgggctcctgcgcgatcaataactggtatgaccgggacattgatcatcttatggagcgtacgaaagtaagaccgacggttacgggtaaaattcagccgagtcaggcgttatggtctggaattttgctggttgctttaggattgatcatgctgctgatgacaactgtcatggctgctgttatcggttttatcggagtctttacgtatgttgtattgtacacaatgtggacgaaacgccgctatacgattaacacagtagtaggaagcgtttccggtgcagtgccgccgcttattggatggacggcagtggaagggaatatcggtgtcgtagcatgggtgttattcatgattttatttatttggcagattcctcacttcttagcattggctattaagaaaactgaggattacagagctgcaaatattccgatgcttcctgtcgtatacggatttgaagtgacaaaaagacaaattattgtgtgggttgcgtgcctgatgccgcttccgtttttccttggtagtctgggtcttccgattgtcattctcggcttgctgttaaatatcggctggctgattcttggcttaatgggattccgctccaagaatatcatgaagtgggcaacgcagatgttcgtttactcgcttaactacatgacaatctatttcgttgccatggttgtcttgacgcttttctaaaaaatagatatgatgcttgttttatcgcttcaaaataaacgatgacaactagtaaatgccgccttgacctcttgtttaatcaggcggctttacttttatacatagatggcattttgagtaaaaaaactcataatttaagagaagaggaaatgtaagtgctttattggtgataggttggatggcgatagatttcgatccgctttccgcctttgtattgaccagaaaaggggttgggtgaaatggtaaagcattggcgtcttattttattattagccttagtgccgcttctattaagcggatgtggaaaaccttttttatccacgctcaagcctgctggcgaggtggctgataaacagtatgacctgacagtgctcagcacattgattatggtggttgttgttgcagtagtatctgttatcttcttttatgtgattgtgagattcagaagatcacgggtcggtgagaacacgataccgaaacaggtagaggggaataaatttttagaaatcacatggaccgtgatcccgattttgctgctcattattcttgtgattcctgttgtattatatacgctggagctagcggacacatcaccaatggataaaaaaggccgcaaagctgaggatgctcttgtagtcaatgttagggcaaatttatactggtgggagtttgagtaccctgattacggcattatcacaagccaggagctgattgtaccgacagatcagcgtgtatattttaatttaaaagcctctgatgtaaaacattccttctggattccttcagttggaggaaaacttgatacgaatacggataatgaaaataagttcttcctgacatttgattcaaaacgaagcaaagaggcaggagatatgttttttgggaagtgtgcagagctttgcggcccttcacatgcgctgatggattttaaggtgaagacgatgtctgcaaaagaatttcagggctggacaaaagaaatgaagaactataagtctacagcagagagcgatttggctaagcagggtgaagaactgtttaaagagaaaaactgcctgagctgccatgcggtagagccgaatgataagcgtgcagaagccgctagaacggcacctaacttggcgaccttcggtgaaaggacaaaagtggcaggggtgaaagaggccaacaaagaaaatgtgaaggcttggctgaaggaccctgacagcataaagccggggaacaaaatgacaggcacatatccaaagctctcagacagcgaaacagatgcgctttatgaatacttaaaaggcttaaaagcggaaagcaagtagggaagaaagggagatattggggaggtcacatatgttgaatgcgcttacagaaaagcggacgcgcggatctatgctttgggattatttgacgacggtggaccataaaaaaatcgcgattctttatttagtggcagggggattcttctttcttgtcgggggaattgaagcgatgtttatcagaattcagcttgcaaagccggaaaatgcgtttctcagtgctcaagcgtacaatgaagtaatgactatgcacggaacgacgatgatctttcttgctgcgatgccgctcttatttgccttgatgaatgcggttgtgcctttgcagatcggggctcgggacgtttcgtttccatttttaaacgcgcttggtttttggctcttctttttcgggggcattttcttaaatctaagctggtttttgggcggagcgccagatgcgggctggacgtcatatgcctcactttcgcttcattctaaagggcacggcatagactttttcgtcctcggactccaaatatcggggctcgggacgctgatagccgggattaactttttggccacgattatcaacatgagggctccgggcatgacgtatatgaggctgcctttgtttacatggacgacatttgtggcctcggcattgattttgtttgcgtttccgccgcttacggtcggattggctctcatgatgctggatcggctgttcggaaccaatttctttaatccggagcttggcggaaatacggtcatttgggaacatttattttggatcttcggccacccggaggtttatatcctaattttgcctgcattcggtattttttctgaggtcatccctgtgttcgccagaaagcgtttgtttggctattcttcaatggtttttgcaatcgtgctcattggctttctgggctttatggtttgggtgcaccacatgttcacgactggtctcggctcgattgcaaatgcgatttttgcggttgcaacaatggctatcgcgattccgaccgggattaagatttttaactggctgttgacgatttggggaggaaatgtgaagtatacaaccgctatgctgtatgctgtctcatttattccatcctttgtgctcggcggtgtgacgggagtcatgctggcagctgctgcggctgattatcagtttcatgatacgtattttgtggttgcgcacttccactacgtcattattggcggcgttgtattcggccttttagccggtgttcatttctggtggccgaaaatgttcggtaaaattctgcatgaaacgatggggaaaatttcatttgtattgttttttatcggctttcacctcacgtttttcattcagcattttgtcggcttaatggggatgccgcgccgggtttatacgtttttgccaggacagggtctggaaaccggcaacttgatcagtacaatcggggcgttttttatggcggcagctgttattcttctgctggtcaatgtcatatggacatcggtaaaaggtgaatatgtaggtgctgatccatggcatgacggacgtacgctggaatggaccgtttcttcaccgccgccggagtataactttaaacagcttccttttgtcagaggacttgatccgctttggatcgagaagcaggcagggcacaaatcaatgacgccggcggaaccggttgatgatattcatatgccaaacggctcaatcctgccgctcatcatttccttcggcctttttgtcgcagcgttcgggctgctgtacagaagtgattacgcttggggtctgccggtgatctttatcgggctcggcatcacatttattacgatgctgcttcgttcagtaattgatgatcacggctatcatattcataaagaggaactgccgaacgatgataaaggggtgaaggcataatgcaagttcaagaaaaattcaccgcagaaacctttccagcttctcctgaaaaagtaaccctggaagggaaaaataaatttttaggcttttggctttttcttggcggagagactgttctgtttgcgtctctcttcgccacgtttcttgcgcttcggaattcaaatgccggtgatccgcctacgacggaaatgttcgatgtgacacttgtattcattgccacaatgcttctattaacgagcagtttaacgagtgtgtacgcgatgtaccacatgaagaacttttccttcggaaagatgcagctttggctgggaattacgattttattgggggcgggctttttaggactggaaatctatgagttcaagcattacacccatgaatttggctttactatcacaagctctgcccttggttctgcgttttacacgcttgtcggtacacacggcgcccacgtggcatttgggcttatgtggatcagcacgcttatgatccgcaatgccaagagagggctgaatctgtatacggcgcctaagttttacgttgccagcctttattggcactttattgatgtcgtgtgggtcttcatctttaccgttgtatatttaatggggatggtgggataaacatggtcgataaaaaaagcagagggcatatcaatagcgaccttgaatttaagaaaaaaaagcatgcccgggagatgaaatatcaagttctgtcttttggtttaatgatcggtcttacgattgttgcatttctgactgtggccacggacggtgtcggcagctggtttacgattcctttcattattttgctagctgcaattcaagtcatctttcagctgtattatttcatgcatatgaatcagaaagggcatgaggcgccggcactgtttttgtattcaggggtgtttgtcgcgtttatcactgtgcttgcgtttgtgacaattatatggtggtaatttgaacagccgccggaggtgaagaaatgaatcagttggagatatttgggtttcgcgcgatgtggagcccttatcttttttgtatcctgttaggcattacggcgctttatctctatttttacaggcgaatgtcttcaaagccgaatcgaataactggtaaagagatggtgtgctttctgtcggcgatgctgtttttatatgcagccgagggaagcccggttgatctgctcggacatattatgttcagtgcgcatatggtgcagatggccgtcctgtatttggttgtcccgccgcttttgatcgcgggaattcctgcatggctctgggaaaaaatcattttcaggccttcaatcaaaccggttttttccttttttacgacgcctttaattgctttgcttttgtttaacggcattttttctttatatcatgtaccgcttatatttgatactgtcaaaaccgatccgttttaccatacattaatcacttggcttatctttgtgcttgcgttcttcatgtggtggccgcttgttcataaggttgagcgtctacggcagctcagcggcttgatgaagctgggttatattatggcggacggtatgctgctcacacctgcttgcgccttgatcatgttcagcggtgcaccgttatacgctacctatacagatccggctgtatgggctgaggcaatgaggctttgcgtgccagcggatatgatggggcaggtcccattaacagggccagagatgttgaatacactgcctttgttagaggatcagcagctcggagcagtcatgatgaaaatcattcaggaaattgtgtacggtacttttttggccattatttttttccaatgggtgaagaaagaaagggaaaaggatgggcaggaggagccgccgtatattcagcagacgatatcataaaaggtacagcgaaatatgctgtaccttttcgttacatttgaactgtttttaacatgttggctatgtcctgaatcagtgccttgctttttgtcacaacctgtacgggaaactcttccgtttctccatattctactccatgagggtagtaatgctttcctaggagaggggacattaattgaatcacggcgcgcccgcttccgacatcgccttctgccgcaataccttgtatccgcaggtaaaacgtaccctcaatcgtcgaaaacttcttgtcataggtgactctctcgtaatcccattgacccgctctgataagacctttgctttccattaagtcgtctagccagctgagctcagccttaaccccttcaagtccgctttcagtaaacttcaacactgacccctccttataaaaattacctttcctgacaatcatagtatgaaagcgttaaactttcaatgaatcttcttcttttgaaagtatgcaaaaattaaattttgacgacaatagcactagactaaaggaggttaaacggatgacaaaaataaaagatctgatgacagccgacttgcaatattgcacggtattagataatgtatatgaagctgcagtaaagatgaaggacgcaaatgtaggagcgattccggtagttgatgaggacggggaaacattggtcggcatcgtaaccgaccgcgatctcgtattaagaggaatcgccatcaaaaaaccgaactcgcaaaaaatcactgacgcgatgactgaaaaacctgtcagtgtggaggaagatgcttcagtcgatgaggttcttcatttgatggcatcgcatcagctcagaaggataccagttacaaaaaataaaaaactgactggaattgtcacgcttggtgatctttctttatctgagcaaacgaatgaacgtgccggcagcgccttatcggatatttccgaaggcgataatagagaagaaggcttttttcattaacacataaatctttgacatgttaaataggctgtattgtaatgggatgtaaacaagagattgtgaatcgccacgggggtgatagattgaaaaatatattgagagcaatggttatcctcttgattatttgcggaacttatgttctgtttattcaatatggatctgttcctgaaaagaaatcaaatgacagcgagcctcaggtgtcaaatgaggaagcgcaaagcggcaaacgaatacatatgccgacctcaggattattgtccttcatgggcaagtccgccgatgaagtaacgaaaaagcttggggaacctgaacgcattgacccttcagcttatgattacgattggtgggtatacaatcaaggtaaggaccaatatatccagatcggggtattaaacaataaagtggtcacattattcgctgctgggaatgatattaacgccaagcctttcaaaattggagaatcaactggcgaagtattcaagaccacccaggtggcaccatttgtgaatgtagagtataaaggaaattcctatcggtttgaattttctgaagaagatatcaatacaagaccgactgtaaaggtaggaaagatgtatgtccagctgtatatggacaaatttgaggggaagctatccagcatcagggcgtttgatgcgcaaacctttgtaaagcaaagaccttatgaggtagtgtaccgcggggaattaattaaaccgaaagccgtttcagatgagaaatggaaaaagatccaaacaacgagcgaaaagcaaatccttgatttgacgaatgtcatacgctttaaacatggacttgcgaagcttgagtgggatcagccaacggcggaggtggcatttggacatagtgaggatatgaaggaaaataattatttctcccatgtctctaaaaaatacggctcgctgaaagaccgcttagaagaagggcatgttgactttcagcaagcgggagaaaatatcgcatacaattatgtggacggtccggctgctgtagaaggctggctgaatagcgaaggccatcgaaaagcgcttctgaattcagattatacgcatcttggtgtcggagtagaccggaaatattacacccaaaattttattaagcgatggtaatgaaagccgcggacgaatggtcccggctttttctatttccatacaaactggtctgaatgaatgtgctgatagcttacagataaggccgtttctcattccttcagtcaggctttttcaccagtgtatagggatatcggttaaaattcatttgggaatgaatataggcgaacacaatgcccgacaaaacgatacattgtagtaggtaacgattttcggagggggtgaggattgtggcgaatcaacatgccaatcattcaatcaatgactttaaacaattcgtcaaaaagcatcccaagctgataaaagaagtgcgcaaagaacaaagaagctggcaggacgtatatgaaaattgggtcctcttcggggagagcgacccgatttgggatccgtatcgggaaccggaagcagctgctgaagctgtgcctgaaacaccgcaaaaaaatgattttatctcgaaaatggtgacagcggtgaaaaagatggatgtcaatcaaatgaacgaacaaatcaataaaatgagccagtcgatctcatcgttgcaaagccttcttaatacattttccggaagcggacagaagcattctcagccaggttctggacagcatcctttttcttttcgaaaggattaaaaaaggggagctcatatgcgcaaagaggttcaggaatatattttagcaaacgaagaacggaaacgattcatcagagaacagccgatatggtaccgcaggctttcaagaaaaccggatgatctgtcctcctttcagcttgaaatgatgaatttttatgaaaaaaccattccgcatcgggtgaatcagtttacgaacgggattcaaatggcgcaaatgatgatgcaaatgtttcaagcgatgcggacaaaagattaaaagaccctgaaaaagggtcttttttcatgcggtcataaggttttgttggcggctgcggttaagcattttccaattggctggtttcatggtaaactaacaactggaggtgcatgttatgtatgcgacgatggaatccgtgcggcttcaaagtgaagctcagcagcttgccgagatgattctgcagtcggagacggctgagaactaccgcaattgttacaagcgtctccaggaagatgaagaggcaggtcggattattcgttcttttatcaaaataaaagagcagtatgaggatgtacagcgttttggcaaatatcatcctgactatagagaaatatcccggaaaatgagggagatcaaacgtgagctggacctgaacgacaaggtggctgacttcaagagagctgaaaatgagctccagtccattcttgatgaggtcagcgttgagattgggacagctgtttcggagcatgtgaaagttccgactgggaacccttattttgacggtttgtcttcatgcggaggcggctgcggttcaggcggaagctgcggatgtaaagtgtcctgacgagactggccgtctcgtcttttacatataagagaaaacaggcaggtgattgtattggagaataggcgccagggcatggttgtgtatctgcactccctaaagcagagcaaaatgctgaggaagttcgggaatgtgcactatgtatcaaaacgattaaaatatgtcgtactgtactgtgatatgaaccaaattgaaaaaacaatggacaagattgcatcttactcatttgtgaaaaaagtggagccttcttataaaccgtttttaaaattggaattcgagtcaaagcttgataaggcaaaagaatacgattataaaatcggcatatagctataaaaaaatccccgcaggcatctgcggggtccttctattccttaatatgttaaggagaaggcaaagggagaggagaaaccggaggaagaacttatggggaaacgtaagtcttctccgcggttggcaacaacatcctctagatgctgttgcttatagtatggacaaggatgattctgcttatacacctgtttatcaagattagcgttcattgtttggaagaatgctttatgttaagataggattgatttttttctatgtacatagcggcgtccggccgaataaagaaacaaaatagcttttagaaaaagtggtgtggaacatgagagtaatttctggatcaaaaaaaggccgttcactaaaggctgtacccggaacatcaacaagaccgacaaccgacaaagtgaaggaatccattttcaatatgattggcccttattttgacgggggcaggggacttgacttattcgcagggagcggaggacttggaatcgaagcgctttcacgcgggtttgagcattgtatattcgttgaccgtgattttaaagcgattcaaacggtaaaatctaatttgaaaacgctggagcttacaaaacatgcgcaggtataccgcaatgatgcggaacgtgctttgcacgctgctgctaaaagagaaaccggctttcgcggcatttttctcgatccgccgtataaggaacaaaagctgaaagcacttttaacgatgattgacgaatatcaaatgctggaagaagacggctttatcgtcgctgagcatgacagagaggtcgagcttcccgaaaccgtaggagatcttgtgatgacaagaaaagaaacctatgggttaacaggtgtgtcgatttataaaaagagggggtagtgaggtggcgagtatagctgtctgtcccggcagttttgatccggtgacctacgggcatctggacatcatcaaacgcggggcgcatatttttgaacaagtgtatgtatgtgtgctgaataattcttcaaaaaagcctttgttcagtgtggaagaacggtgtgagcttctgagagaagtgacaaaagacattccgaacataacagttgaaacatcgcaaggcctgttaatcgattatgcaaaaagaaaaaatgcgaaagcgattttaagaggcttgagagctgtatctgattttgaatacgagatgcaggggacatcagtaaaccgtgtgcttgatgaatctattgagacattttttatgatgacaaacaatcaatattcgtttctaagttcaagcatcgtaaaagaagtggcaagatacaacggctcggtatcagagtttgtaccgccggaagtagagctggcgcttcagcaaaaattcagacaaggatgagggttttgactcatcctttttttgttccgtttgtcagtctgtaagaaaaaatgataatgtacgtaaacagcgcgcatagtgtgacagcaggtccgatctgcacaagcagattccagccgtttataaaggcagttggcatgtcactgctgttaagagatttaaatacatactgatacggatcatgccatgccgtgtaaagaggtttccataaaagcatgacgaagacagcggcataaacgccctgcagcaaacgtgcgataaagaatggtttaaatctaatgtcggtttccgataaaatacctgccacctgagcttgtacggaaaagccgctaaacccgagaataaagctgacgataatggctttttgcagaagagaaacatctgtctcgctgacaagcttgctgcctaatgtaatttcaaacatccctgataaaagcggaatgtccaattgagtcggaagctgaaacaaagtcagtgctccttttgtgaaaacagacaaaacatcagtcaactggaccactgacaacagccgattgaagacagaaaataaaataataaagccgcctaccataagaagcgtttgaacagaagacgtcacggcgtcgcctaaaattttacccaagggccgtttttctgcaagtctggcggtatgaagagcgtgtaaagcatctttgactgaagggaaaggtatcgttttctttcttctgagatgctgctcttccttgcggccataggaacgcattgttaaaccgacggcaagattccccaaatagtgtgcagaagctaataaaatgcctagtgatgcgttttgaaagaaaccgacggcaacagcgccgaaaataaagagcgggtttgaagaattggtaaacgacgcgagccgttctgcttctactcttgaaatctgattttcctgccgcagacgggcagtgagttttgcgcccgctgggtttcctgatgccattcccatagcaagaacgaagccgccgacacccggcacgcgaaagatcggccgcataaaaggctcaagcaaaacaccgacaaaccgcacaatgccaaagccgattaagagttcggacagaataaaaaatggcagcaatgacggaaacacaacctcccaccacatagacagcccggttttagaggcttcgaatgaggcctgtggatgtgagatgacagtcgctgttaaaaaaagaaaaaacgaggcaatcaaaagtgtattaatcttcgacaagttcattcttacctccccgatgctaaaaatgcccaatgacatgtatatcatgataaaataatgtatgatgtaaaacggccaagcagtacctgtcctcttgattctttgtactaatatacgagcataggggttcagtttagaccatagaattcggtatacagggaattcaggcaggaggttaacgctttggccaaacctaaaatcgggttagcgttaggatcgggaggggccagagggcttgctcatctcggtgtgctttccagtttacataagcaccaaattgaagtggatatgattgcaggaagcagcatgggcgctttggtgggcagtttttacgccgccggacatgacgtggcaacgatgaaaaaagtagccaaagcctttaaacgaaggctttatgctgattatacggtgccgaagctcggttttttaaaaggtgaccgcgtcagacagcttgtgcatgcttatacattcggaaaaccgattgaagagctccaaatcccgctgggcattgttgcgtgtgatctacagacgggagaaaagattgtgttccgaaaaggatcagtgtcagatgcagtgagggccagcatcagcatcccgggtatctttattccgcagcggctggacggacgccttcttgtagacggcgcggtcgtcgatcgaattccggtttctgttgtgaaagacatgggagctgatattatcatcgcttcggatgtttccagggttcgaaaaactgaaacagcagtgcatatttttgatgtgattatgcaaagtatggatatactgcaaaatgaattagtgcggcatcaaacaattgccgcagatatcatgattcgcccttcccttgaaacatacagctcaagctcgtttgccaatattgaagaaatgatatcggcaggcgaagaggcgacaaaccgaatgatcagcaagataagaaaagaaatagagaattgggagggctcataatttgctacgtaaaaaacattttagctggatgctcgtcatcctcatactgatcgccgttttatcatttataaaacttccatactatattacaaaaccgggagaagcgacagagcttgcttcattgataaaagtggagggaggctacccggaaaaaggaagcctgtccttaatgactgttaaagtgggaccggctaatccgtttacatatgtgtgggcaaagatgcacccttattatgaaattgttcctgatgagagcattaaggaggaaggcgaatcagataaggagtatatgaaaagacagctccaaatgatgaaaagctcgcaagaaaatgcggttatagccgcctatcaaaaggcaggaaaaaaagtcagctattcctttaacggcatatacgcaagctcagttgtagaaaacatgccggcaaaagagaaaatagaagtcggtgataaaatcatcagcgcagacggcaaaaactatcagtctgctgaaaagctgattgattatatcagcagcaaaaaagcgggagataaagtcacgttaaagatcgaaagagaagaaaaagaaaagcgtgtcacccttacgttaaaacaatttcctgatgagccggatcgggcaggaatcggagtttcgctttatacagacagaaacgtgaaggtagagcctgatattgattttgaaatcgaaaatattggcggcccgtcagcagggttaatgatgtcccttgaaatttataatcagctgacaaaaccagacgaaacaaaaggctacgatattgcgggaacaggtaccattgatgttgatggaaaagtaggcccgatcggcggcattgatcaaaaagtcgtcgccgcagacaaagccggaaaagacattttcttcgcgccaaatcaaaacggcgccagcaattccgattataagaacgcagtaaaaacagcaaaagatattgattcaaatatgaagattgtgcctgttgataccatgcaggatgcgattgattatttgaataagctgaaagcgaaaagcacctgattctcaggtgctttttctatacatttaaaaagtgttgttcatcttcgtcatatcgaatcggtgcatgtccgtattccttcaggtcaaactcagttctcagcggctcttctatcggcaggctgtaaatcctgcttgcttttacgtccagatcgagagctggatgggagaaagaggacagtttgctgacaagcggaacagacagtgcttttttcttttcggataaataagcctgtccttttttcgtcatgccgagaagcctgatatacggcaccttatcgttgtcaagcagcttttgcatatccagtttttttgttctggttaaaatgtgtgtattcatccgctggagccttgtccacgtatagcgttttgttttcagcagctccataaattcctgataggagctggattttctgatcgaacgaagaattctgtgctctaaaccttcctccacctcgtatacttgctgtaattcctgtgctgttacagttgaaaggctgtattttaagtaagaaaagtagctctcaggtgtatgccacaatccgaaagatttgcggtaagctgctaattcacgtgcagatgcagcagggataaaacgaaggcaagcttcgagattctggccagtcatcgcttttctaatgcttgtggcgcttgcgatatggttttcgccttcagggagatcggcatcatgatagtccgaagagattcgtgccgtagtataaggtttcataggatatcccccggttagaatcgaggtcacatactggcatcccaaaatgttatttggttttgacaagtcaagtgcactttcagtatgcaaaatggagctgaaggcgctagccgccgctgctgggtaactggccccctttttaagttcttctttaattcggtcattcaatatatgtttatgctcatcaataagctgtgctgtttctaaaaaaggcttgatatccccattttcactcccgaaaaacagcgcctcacattcaagttcgttcaggattgaaacactgccgcgtgcaaaaatgtctgctttttgcacggcataaagataaggcagctcaatgacaagatcaactccgctttgcagcgccatttttgttcgggcccattttgatacaacagcgggctccccgcgctgtaaaaaatgcccgctcatgaccgcgacagccgtgtcacatccggtttgccgctttgctgtttgggcatgataaaggtgaccgttatgaaagggattatattcaaccaccaatccgacagctttcatattttttccgcctttcttgctatgtttaaaaacgtatggtacatttgcaaatgaaaactcttacgccttatttttgttttaagtgtatgcatagcatattccgctgtcaacgatacttcaatggcagcattatgctgtaaagaaaaaatattgacaaaaacaatcttaaaagctataatcatgtttgttgctttcctgaggtgatacaaatgaaatggacgatttatcagctgcatcaaatgccaaaacaaagttttgagtttgatgaaacagttgagttaaatgagctgacaaagctgaattctgacattcgccgcatttctcccgtccgggtgaagggcagagcggatatcaaatccaaacaggtttcgtttgattttacaatttcaggcgaaatgattttgccatgctcaagaacactcgttgatgtcccgtatccatttgaaatttcaacaaaagaactgtttatatttcatcacacggatgatatagaagatgatgacgttcacattgttgaggacgatactatcgacttaactccgatcgtgaaagaagaaattcttttagaaatccctatgcaaatcttttgtgaatctgaacaagaaaaaggagctgctcctcaagaaggaaaggattggcaagttatttcggaagaagacaagaagaatcaagttgatccgagacttgcagcccttgaaaagctcttaaaacaagatgatgaatcttaactctttaaggaggtgggaataatggctgtaccttttagaagaacttctaaaatgaagaaaagattgcgccgtacacatttcaaacttaatgtacctggtatgacagaatgtccgtcatgcggagagatgaagttgtctcaccgtgtatgcaaagcatgcggatcatacaacggcaaagacataaatgtaaaaagtaactaataagaaaagcgcggggtgaaagccctgcgctttttctttttctcttcctgtcagcttgcggaaaatttgtgagtgcaaatagtctatctaatctattaccggcatatgtatgagataaataagctgacatggagggagattgaatttgaccattacaagacaagatgcttggactcaggatgaggatttgctgctggcagaagtggtgcttcgtcatattcgagagggaggaacacagctttctgcctttgaggaggttggaagggcgctgaccagaaccgcggcagcctgtgggttcaggtggaactcgtatgtgagaaaacaataccagtcaggtatagagcttgcaaaaaagcaaaggaaagaactgagaaagcaaatcggcgttcattcggtcaatatgccgaattccatgaagcagactgcctcggcatcgtcggaaggaaaacgagatttgtccattcaggatgtcattcaatttctcgaacaattcaaagaagcaccgtctgcacaagaatttcagcttgaaagggaaaaattgaaggagcaaatccaatcgctgcaaaaagagcttgaggatttgcggagtgaaaatcagacattgcggaatcagctagagatgacagaagaggattacaaggcactgatcgatatcatggatcgggccagaaaaatggttgtttcgaaggaagacggaagaatgaaaaaagcggctcaagaaacataaagaaacgcctgaaatgaaccggccctatagtaagaataggccggttgtttttatttctatgcagactctcccggtgtcatttcgcgatccatatcaggatgccagatgagcgggttttcccctttgtcccgcgccatatcatacttaacagttttaaagttcattttgttccaaaattccgctgatttcattctcggatttgtccggatcggcattttgaatgattttgcaaattcaaccaaggctctcccgtatcccctgttctggtagcccggaagaacctcaagcttccacagctccaaataatcctggcggttgtcaaaatagggattcgatttgccgttaacttgatacagactcattcgtgctacaagtttatcgccaaaataaatcccgtaaaaaggcgaggtgctgtcattttcaataatattatcctgaagttcttcaagcattgaaagctcctgaatgccgtattctttgaatttcttgaattcttccagcgttttatagttgataagcagacgttctacctttgtcaaacaaatctccccctttggtgtttctatatatattgtaaacgctttatttaaaaaatccaaatatttaaactttaattttaagcacatgggatctttgagaagtaatttcttcttacttctgctatgataatacgtaaatgctaaattgggtgtgacatcatgaaaattggaattatcggcggaggctccgtcggtcttttatgcgcctattatttgtcactttatcacgacgtgactgttgtgacgaggcggcaagaacaggctgcggccattcagtctgaaggaatccggctttataaaggcggggaggaattcagggctgattgcagtgcggacacgagtatcaattcggactttgacctgcttgtcgtgacagtgaagcagcatcagcttcaatctgttttttcgtcgcttgaacggatcgataagacgaatatattatttttgcaaaacggcatggggcatatccacgacctaaaagactggcacgttggccattccatttatgttggaatcgttgagcacggagctgtaagaaaatcggatacagctgttgatcatacaggcctaggtgcgataaaatggagcgcgttcgacgatgctgaaccagaccggctgaacatcatgtttcagcataaccattcggattttccgatttattatgagacggattggtaccgtctgctgacgggcaagctgattgtaaatgcgtgtattaatcctttaactgcgttattgcaggtgaaaaatggagaactgctgacaacgccagcttatctggcttttatgaagctggtatttcaggaggcatgccgcattttaaaacttgaaaatgaagaaaaggcttgggagcaggttcaggctgtttgtgggcaaacgaaagagaatcgttcatcaatgctggttgacgtcattggaggccggcagacggaagctgacgccattatcggatacttattgaaggaagcaagtcttcaaggtcttgatgccgtccacctagagtttttatatggcagcatcaaagcattggagcgaaatacaaacaaagtcttttgagctttttcggtaacatgctatactcatttcggatcactaactatttattggagaaaggaagttctagaagatgcagctaactgaactttccatcaaaaatcagaatgtgtttgtacagcactatatagatggcaaagaagaaatgtcttctttttttgattacagtattcatcataaggacatgtggcgcgaaagactggaagacttatcttcccggtttttcgcaagagaggaattggcggcgtacttaacctcttaccataataaattcggttcaagtgcgatgcagtctgctattgagaagctgaaggacccgtcaagtgccgctgtagtcggcggacagcaggcaggacttttaacaggaccgctttacaccatacataaaatcatttcaatcattgttttagcaaagcaacaagaaaaggaactgcaaatgcctgtcataccaatcttctgggtggctggagaagaccacgatttggatgagattaattttgttcacacatctgaagagaatgggcctgtgaaaaaaaagctgcctcagtcttattggaagaaatcatcagcagcgagtacatcgcttgatcaggaaaagtgtgccgcgtggatagatgatgtttttgccgcttttgaagaaacagaccatacgaatacacttctcgacaatgtgaaacgatgtttaagggaatctgttacgtttactgacttctttgaactgctgatcgcggatttgttccaagaagagggcttagttttattaaattctggagatccggggattaaaaagctggaaacggccatgttccaaaagattcttcgagaaaatgatgaactcgcccgggctgtatcagatcagcaggccttcatgcgtcaagcaggctacaaaccgattatcgagtccggaaaagagcaggcgaatctgttttatgaatacgaagatgagcgttttttaattgaaaaagataacggccgatttgtcatcaaagagcttgatctaggatggacgatggatgaacttcatacacatatggaagaacatccagagcgtttcagcaacaatgttgtaacgagaccgttaatgcaggaatttctcattccgactttagcatttattgcagggcctggagaaatcaattattggggcgagctcaaacaggcttttgcggtgatgggcttcaaaatgcctcctgtcatgccaaggctgaacattacgatacttgagcggcatattgagaaaaaactggctgaacggaatatctcgttacaagacgcgattgagcgcggaacggagaatcaaagagagacatacttcgagcgccagattccggaagagtttacggcggtgatggatcaggcgaaaagccaaattgaagcgattcacaaaacggtccggcaggaggcgttaaaggttgatcaaagcatggaacctttactcctgaaaaatgccgcttttattcaggatcagcttcaattcttagagcgcacggtgacgaagcgaattgaagaaaaagaaggctacgttttgaaggattatgaaagaattcaaaatagcattaagccgcttcttgcgccgcaggaacggatttggaatattatgtattatttgaacaggtacggtccaaaattcttcacgacattcaagaatctgccattttcttttcaaaatcaacatcaagttgtcaaactttgaaataaagttttaaagaaccctgaatagttcagggtttttttttatgggtaaacagtgtaaaatgaagttgtggagcgaagtggtgaatagtggtgagttaaggagagaaagtggggcaagagatcatgtttatgggtgaatatcagcataccatcgatgcgaaaggccgcatgatcgtacccgctaaattcagagaaggcctgggtgagcaatttgtgctgactagaggacttgaccaatgtctcttcggctaccctatggacgaatggaaacaaattgaagaaaaactaaaagctcttcctctcacaaagaaagatgcccgcgcgtttacccgtttcttcttttcaggggcgactgaatgcgaactggacaagcaaggcagggtaaatatcgcatcatctctattgaattacgccaaactggaaaaagaatgtgttgttatcggggtttctaatcgaattgaattgtggagtaaagtaatttgggaacaatacacagaagagcaagaagattcatttgctgaaattgctgaaaacatgattgggtttgatatataatgattcttcgtgtataacactctaaaaacaatttcaattcatcctgataaaaggtgggaccaacacaatatgtttcaacacaagacagtacttcttcgtgaaaccgtagacggactcaatattaagccggacggtacatatgtagactgcacactcggcggagctgggcacagtacatacttattgcagcagttatccgagaaggggcgtttaatcgcttttgaccaagatgatacggcattacagcatgctaaagaagtgttgtccgactataaaggacagctcattctgattaaaagcaatttcaggtatttaaaagaatgtttgaatgaacaaggcattacagaagtagacggtattttatttgatttaggggtgtcctctccgcagctggatacaccggagcgcggattcagttaccatcatgacgcaccgttggacatgaggatggaccagtcggctacgcttacggcgaaagaagtcgttaatgagtggcgctatgaggatctcgtccgtattttctttaaatacggagaagagaagttcagtaaacagatcgccagaaaaattgaggaggcaagaatgaagtctcctattcaaactacgggccaactggtcgatctaataaaagacgcgattcccgctccagcgagaaggagcggcggacatcccgctaaacgcgtgtttcaggcaatcagaattgccgtaaacgatgaacttagggtgtttgaagaagctttggagcaggcaattgaggttctgaagccagggggcagggtatcagtcattaccttccactcgctagaagacagaatttgcaaaaccacttttaaagaaaagtcgtcgcttccggaacttcctccgggacttcctgttataccggaagagtttgaaccggagctgaagctcatcacacgaaaaccgattacggcatctcaagaagagcttgaagagaacaaccgggctcgttctgccaagcttcggattgctgaaaaaagaaaataacgaaacgcgaacgcaaaattaaaaggaggtcatcagcctatgagcaatttagcttaccaaccagagaaacagcagcggcatgcgatcagtcctgagaaaaaagtgattgtcaagaaaagggcttccattactctcggagaaaaagtgcttcttgtcctctttgctgcggcggtgctcagcgtatcgcttttgatcgtatcgaaggcgtatgcggcatatcaaaccaatattgaggtgcaaaagcttgaggagcaaatttcatccgaaaataagcaaattggtgacctcgaaaaaagcgttgctgatttaagcaaaccgcagcgcattatggacattgcgaaaaagaacggcttgaatttaaaagataaaaaagtgaaaaacatacaggaatgattcaaatgccaaaaaagaataaatttatgaatagaggagcagcgattctaagtatttgtttcgctctctttttctttgtcatcctggggagaatggcatatattcaaataaccggaaaagcgaacggcgaagtgcttgcgacaaaagcgacagagcagcatgaaaagaaacggaccatcgaagcgagccgcggctcgattttagaccgaaaaggaaaagtcattgcagaggacacagcgacgtataaactgattgcgattctcgataaaaaaatgaccactgatgtcaagcatcctcagcatgttgtaaacaaagaaaaaacggcggaagcattgtctaaagtgataaacttggacaaggccgacatccttgatatcttaaataaagatgcaaaacaagtcgagtttggctcagctggccgggatattacgtattcacaaaagcaaaaaatcgaaaaaatgaaactcccgggcatttcatttttacgggatacaaaacgctactatccaaacggagtatttgcatctaatctaatcggctatgccgaggttgatgaagaaacaaatgaaatttccggcgcgatgggattagaaaaagtgctggataagtatttgaaggagcgcgacggatatgtgacatatgaaagcgataaatccggctgggagctcccgaacagcaaaaataaaattacagcgccaaaaaatggtgacaatgtatatttaaccattgaccagaaaattcaaacctttttggaagacagtatgacaaaagtggcgcaaaagtataatccgaaaaaaatcatggccgcagttgttgatccgaaaacaggcaaagtgcttgccatgggacagcgcccaagctttgatccgaacaagcgcgatgtgacaaactactataatgatttgatttcatatgcgtatgagcccggatccacgatgaagatttttacactcgctgctgcgatgcaggaaaacgtgtttaatgcgaatgaacaatataaatcagggacctataaagttggcggcggaaaagtatatgaccataacgggggtgtgggctggggtcccatatctttcaaagacggggtgcttagatcctctaacgttgcttttgccaaattagcaaatgaaaaattaggttttgatcgttataatgagtatttgcataaatttggtttttatcaaaagacaggaatcgatctgccgggagaagcatcaagtaaaatgaactttaagtatgattacgataaagcttcaactgcatacggccaagcatctgcagtcaccccgattcagcaactagaagcagcgactgccgtcgcaaatgatggcaaaatgatgaagccttatgtcattgatcatattgttgatcctgatacgaagaaaaccgtttatcaaaataaaccggaatctgcaggaacaccgatctctgccagtacagctaaaaatgtgcgtgatatcctgggagacgtcgtttcatcagacattggaaccggacgcccttataaaattgagggctttgacgtggctgggaaaacaggtacagcacaaattgcaggaacgaatggttatttaaagggacgggataactatattttctcatttatgggaatggctcctaaagataatcctgagttgttgatttatgttgcggtacagcaaccgcaattagaggatgatgaaactggctctgatccagtatcagaaatcttcaatccaacaatgaaaaatagcctgcactacctaaacatcgaaccaactgaaaaatctgactcagataaggaagaaacaaaagcgcagacaatgcctgatttaacagatcaaacggtagctgctgctcaaaagaaagcaaaagaggagaatctcacaccaattgtcatcggcagtgatgtcgctgtaaaagaacagtatccgaaagcggatgaggaagttctcaccaatcaaaaggtcttcctgaaaacgggcggcaaaatcaaaatgcctgatatgacaggctggtcgagaagagaggttctgcagtacggcgagctcgcgggaattcatattgaagtaagcggacaaggctacgctgtcaaccaaagtgttaagaaagacaaagaaatcaaagacaaaaccgtaatcaaggttaagtttaaaaatcctgattaaaaagaaagcctgcgttatgcaggctttctttttttatgccttcagaggagcatcgttctacctgtccaatttcaggcataaaatgaaacaagcctaaataaggagtgaacggtctcttgcgcgtctcgaatgtaacggttagaaaacgtttattatttgttttgctttttggcgtgatcgtgtttctgatcattgatacaaggctggggtatgttcagtttgtgatgggcgaaaaactgacttcgctagcgaaagattcctggagccggaacttgccgtttgagccggagagaggcgagattctggatcggaatggtgtgaagctcgcaacaaataaaagtgcgccgaccgtattcgtcgtgccgcgccaagttcagaatccgatgaaaacgagcaagcagcttgcggcggtgctcaatatgtcagaagaaaaagtatataaacatgtgacaaaaaaagcgtcaatcgaaaagatcactcctgaagggagaaaaatttcaaatgagaaggcgaaagaaatcaaagcgcttgatttaaaaggtgtgtatgttgcggaggacagtatccgtcattacccgttcggcagctttttatctcatgtgcttggatttgcaggaattgacaaccaagggctccttggacttgaagcctattacgacgatgatttaaaaggggaaaaaggttctgttaagttttatacagatgccaaggggaagaagatgcctgatgaagcggatgactatacgccgcctaaggatgggcttgacatgaagctgacggttgattcaaaggtccagacgataatggaaagagagcttgataacgctgaggccaaatatcatccggacggcatgattgccgtagccatgaatccgaaaaacggagaaattttggggatgtctagcaggcctgacttcgatcctgctgattaccaatctgttgatccgtccgtctacaatcgaaatctgccagtatggagcacgtatgaaccgggatctacctttaaaattattacacttgcagcagcccttgaagagcaaaaagtaaatttgaaacgggatcaattttatgataaagggcatgcggaagtggacggagcgagactgcggtgctggaaaagaggcgggcacgggctgcagacgtatctggaagttgtgcagaactcctgcaacccggggtttgttgaattaggcgagcgcttaggaaagaaaaagcttttcaaatatatcaaagactttggttttggacaaaaaacggggattgatctccaaggcgagggaacaggcatcttattcccgcttgagagagtgggcccggtggagcaagcaactacggctttcggacagggagtatccgtcacgccgattcagcaggttgcagcagtatccgccgctgtaaacggaggaacgctctacacaccttatattgcaaaggaatggatcgatcctgttacgaagaaaacggtcaaaaaacaatcaccaatcgcaaagaaacaagtcatttctgaggaaacatccaaacaaatccgctatgctctagaaagcgtcgtcgcagaaggcactggccgcaatgcatttgtagaaggatatcgtgtcggaggaaaaacgggaactgcacaaaaggttaaagatggaaaatatcttgaaaacaaccatattgtatcatttattggtttcgcgcccgccgatgatccgagtctagtcgtctacgttgcggtggataacccgaaaggcacgattcagtttggcggaacggttgcagcgcctattgtcggaaatattatgagagacagtctgccggaacttggtgtgaagccccggaaaaatcaaatcgagaaaaaataccaatggaacgacacaaaaacaatagaagttccgaatgttgtagggatgtctgtctcagatcttgagtcactattggtgaatctcaatgtggatgcttccgggaaagggagcaaaatcgttaaacaatcgccagctgccggaacgaaagtaaaagaaggctcaaagatacgcgtgtatttgactgaagaagatgaaaaggaggcagccgattgattcggactgcctattcttttattgcagaaaaaatgctgatatctttcaagattagctggatgtatccttttatttacgctaaaatatgaactgtatgcttaaaatcattaccacatcatttgatgtgacttcaatgataaaaagaacgaattagaatgttgagaggtttgatacgatgaaacttacaaagctgcttacatacttaacaaccgaaccttctgtaaacgactcacaagaccctgaaataacttcaattgagatggactccagggaagtaaagaaagggagtctttttgtatgtgtaaaagggtatacggtggatggccacgattttgcgcaaaaagcagtagaaaacggtgcagcggctattgtggcagaaagagaggtcgatgtgaatgttcctgttattattgtccggcagtcacttcgcgcgctcagcgttttgtctgatgcgttttacggacagccgacgaagaagcttcagctgattgggataacagggacaaacggcaaaacatcaacgacccacatggtcgatgagattctgaaaaaagcgggaaaacgcacaggcttgatcggtacaatgtacatgaaaatcggagacgaaacacttcctgttaaaaacacgactccggaaagcgtcacgctgcagaaaacgtttaagaaaatgaatgacaagcacgttgacactgctatcatggaggtttcttcccacgctttgtctttaggacgcgtccatggctgtgattatgatattgccgtgtttacgaatttaacacaggaccatctggactatcataaaacgatggatgagtaccggcatgcaaaaagcttgctcttttcccaacttggcggggctttcaaccatgaacatccaaagcgtgccgtactgaatgctgacgatgaggcgagcgcttattttgaaaaggtaacagctgcgcatatctctacatacggaattaaaaacgatgctgatgtgatggcgaagaacatcagtatcactgcacagggcacaagctttgatctcgtgacaaacaaaggcacgaagcacatcacgatgtctctcgtcggacaatttaatgtgtataacgtgctggccgctgttgcaacatgtattgcagcaggcataccgtttgaaatcatcactgaggctgttgaagaattgcatggtgtaagaggacgttttgaattggtcaatcagcagcaggagtttcctgtcattgtagactacgcgcacacaccggacagccttgaaaatgtgctggagacatgcagagacatgacggaaggaaagctatttgtcgttgtcggctgcggaggagacagagataagacgaagcgcccgaaaatggctaaaattgctgtggagctggctgacgagccgattttcacgtcagataacccgagaagcgaagatcctcgcgcgattttaagagatatggaagccggagtagagaacgcatactatcacagtattgcaaaccgcgagcaggcgatctttttcgcaattgccaatgccaaaaaaggcgacgttgtcctcattgccggaaaaggacatgaaacctatcagcagatcggaaatgaaactttcgattttgatgatgctgaagtagcggcgagagccattgttgaactcaataagaataagacgaattcataggaaagagatgttactgaataatggagcttaaaaagatttttcatatggaaaaaaatcatgaatatgataactacgtatgtcgtttgaaagaaacaggaggagaataggacaatgcttgagcaagtcattctgtttacaattttaatggggtttttaattagtgttctgctctctccgattcttattccgtttttaagaagattaaaattcggccagagtattagagaagaaggaccgaaatcacatcagaaaaaatcagggacaccgacaatgggcggggtcatgatcatactttctatcatagtgacaacaattgttatgacacagaagttttcagaaataagccccgaaatggtgctgcttctgtttgttacgctaggctacggtttgcttggctttttagatgattacatcaaggttgtcatgaagcgcaatcttgggttgacatcaaagcaaaagctgatcggacaaattattattgcagttgtattttacgctgtgtatcattactacaattttgcgacggatattcgcattcctggaactgacttatcatttgatcttggctgggcttactttatccttgtgctctttatgctagtcggcggatcaaacgcagttaacctgactgacggccttgacgggttattatccggtactgcggcgattgcctttggcgcctttgccattctggcatggaatcagtctcaatatgacgtagcgattttctcagttgccgttgtcggtgcagttctgggcttccttgtatttaatgctcatccggccaaagtttttatgggagatacgggatcgcttgcattgggaggagccatcgttaccattgccattttaacgaaattagagatcctgctggttatcatcggcggtgtattcgttatcgagacattatccgttattttgcaggtcatcagctttaaaacgacaggtaaacgaatctttaaaatgagtccgcttcatcaccattatgagcttgtcggctggtctgaatggagagtagtcgtgacgttttgggctgcgggacttttgcttgccgttttaggaatttacatcgaggtgtggttataagtggaaaatgatcaatttttacagaaacagcattttttaatccttgggcttgcgaaaagcggatatgcggcggcctccattcttcatgaaaaaggcatttatgttgcagtcaatgatcaaaagccttttgaagaaaatgaaccggcacaaaagctttctgaaaaaggaatcgaagttgtttgcggagagcatccagtttctctgttcgatcagcatcaaatcacgattctgatcaaaaacccgggaattccttatgaaaatatcatggttcaggaagcagagaaacgaggcattccggtttggacggaaattgagctcgcttactacctgaccagcgccaagtttatcgggattaccggatcgaacggtaaaacgaccacgacaacgctaatttacgaaatgctcaaggctgactcgcaaaaagcactgattgccggaaacatcggcacagtcgcaagtgaggttgcctatcatgctgatggagatgaatggatcgttaccgaactgtcttcgtttcagctgatgggaacacacgctttcagaccggaaatcagcctgattttaaatgtatttgacgcccatctggattatcaccatacgcgcgaaaactatgaaaaagcgaaacagaaagtgtaccttcatcagactgcttcagataaagccattgtcaaccaggatgatgaaaccgtcgtgcgtcttgctgaagccggaaaagccgaaatcgtcccattttcagtcagcaaaacgcttgaacagggcgcatatgtaaaagacagtatgattatgtttaacggcgaagccattcttcctctggaagaggttgtactgcccggtgctcataacctggagaacattttagcagctattgcagttgtgaaaacggcaggagcatccaatgaggcggttaaaaaggtgctgacaagctttactggtgtgaagcaccgcctccaatatgtcacaactgtgaatggccgcaaattttataacgacagtaaagcaacaaacattctggcgacaagcaaggcgctttcagcttttgataagccggtcattctgcttgcgggcggactggatcgcggaaatggttttgatgacttgaaaccttatatgaagcatgtcaaagcagtgcttacatttggccagacagcgccaaaactcgagaaactcggcaatgaactgggaatacaacatgtcaaacgtgtcgataatgttgaacaagcagtatctgcggcgtttgcgatctcaaatgaaggagatgtcatcctgctgtcacccgcgtgtgcgagctgggatcaattcaaaacatttgaagaacgcggtgacatgtttatagatgccgtgcatatgcttaagtaagggcttgtcttgaagtaaatcggcagccctaatgactttaagcttggggtgtcgattgctttgactactaaaaaaacatcgcctgatttgttattggtcatcattacgttattattattaacaatcggattaattatggtgtacagtgcgagtgcggtatgggcggattataaatttgacgactcattctttttcgcgaaacggcagcttttgtttgcgggaatcggcgtcattgctatgttttttatcatgaatgtcgattattggacttggaggacatggtccaaattgctgatggttatctgctttttccttctggtgcttgttttgataccaggcgtcggaatggtgcggaacggttcaagaagctggatcggagtcggtgcattcagcatacagccttcagagtttatgaagcttgcgatgattgcattccttgctaaatttctctctgaaaaacaaaaaaacatcacatcgttcagacgggggttcgtccccgcacttggcatcgtgttttcagcatttttgattatcatgtgccagcctgacctcggaacggggacagttatggtcggaacttgtattgtcatgatttttgtagccggcgcacggatcgcccatttcgtctttctcgggctgatcggcctcagcggatttgtcgggctcgtactatcggctccatatcggataaagcggattacctcatacttaaatccatgggaagacccgctcggaagcggatttcagatcattcaatcgctttatgcagtggggccggcgggttgttcggaatggggctcggacaaagcagacagaaattcttttatctgcctgagccgcaaacagactttattttcgccatcttgtcagaggagctgggctttatcgggggaacacttattttgctcctcttcagcatcctgctgtggagaggaatcagaattgcgcttggtgcgcctgatctgtacggaagctttgtcgcagtcggcattatttcaatgattgccattcaagtcatgataaatatcggcgtagtcacgggcctgattcctgtaacaggcatcacgctcccgtttctgagctacggaggctcttcattgactctaatgctgatggcagttggtgtgctgctgaatgtaagccgctactcgaggtattaacgaatgtatgtccaagcttcctgtctaacatgaagcttggaaacaattgatgcgataaccctgtccaacaaaacagggttatcgttatgttatagagaaacttagactgggggaaaagaaatgcgaattgcaataagcggaggcggtacagggggacatatttatcctgcgcttgcttttattaaagaagtgcaaagacgtcatcctaatgtggaatttttatatatcggaacagaaaacgggctggagaaaaaaattgttgagcgggagaatataccgtttcgttcaattgaaattacaggatttaaaagaaaattgtcatttgaaaatgtcaagactgtgatgcgttttctgaagggcgtcaaaaagagtaaatcgtatttagcggaatttaagcccgatgccgtaattggaacgggcggttatgtatgcgggccagttgtctatgccgctgcgaaaatgggaattccgactattgtccatgaacaaaacagcctgccgggtatcacgaataagtttctttcaaaatatgttaataaagtagcgatttgttttgaagaagcgaaatcacattttcctagcgagaaagttgtatttacgggaaacccgagagcctctgaagtcgtctcaataaagacgggacgatcaatggctgaatttgggctttctgaagacaaaaaaacggtcttaattttcggcggaagccgaggcgctgcaccgattaaccgcgctgtcattgacatgcaggatgcgctgaaaacaagagactatcaagtgctgtatatcaccggtgaagttcactatgaaaaagtaatgaatgagctgaaaagcaagggtgccgctgataatatggtcacaaagccgtttcttcatcaaatgcctgagtatttaaaggccattgatgtcattgtggccagagccggtgcgacaacgattgccgaaattactgctctcggaatcccaagtgttctgatcccgagtccatatgtgacagcgaatcaccaggaggtcaatgcgagatctctcggccagcatgatgcggcgattgtactgaaagaaacagagctcagcggggagaagctgattgaagcgctagaccggattgtactgaatgagcaaacgttaaaggaaatgagcgaacgaacaaagtcactcggtgttcctgacgcggctgcccgtttatacagcgtactcgaggaattaaaaaaatagtagaaaagcaaatggaatgcggaggtttacgatggagaaagtgatacaggaattaaaagaacgcgaagtcggcaaggttcttgcaaatgaaccgctcgcgaatcatacaacgatgaaaatcggcggacctgcggatgtattggtcattccaagcagtgtagatgctgttaaagacatcatggacgtgattaaaaaatatgatgtgaagtggacagtcatcggccgcggatcaaatcttcttgttttagatgaaggaattagaggcgtagtaatcaagctgggtgcgggtcttgaccatttggagcttgaaggggagcaagtaacagtcggaggcggttattcagtggtccgccttgctacatcattgagcaaaaaaggcctgtccggtttggaatttgctgccggcattccaggatcagtcggcggagcggtttatatgaatgccggcgctcacggttctgatatgagcgagatcctcgtcaaagcgcatattttatttgaagacggaacgattgagtggctgacaaatgagcagatggatttcagctataggacatctgtactgcaaaagaaacgcccgggcgtttgccttgaagctgttttacagctggagcagaaggataaggaatcaatcgttcagcaaatgcaaagcaataaagactatagaaaaaatacacagccgtattcaagcccttgtgcgggaagcatattcagaaatccgcttccgaatcatgccgggaaccttgtagaaaaagcaggcttgaaaggatatcaaatcggcggtgcaaagatatcggagatgcacggaaacttcatcgtcaatgcgggggagcatcagcaaaagatgtgcttgatctcattgaccatgtgaaaaagacaatccgtgaaaaatacgagattgatatgcacacagaggttgaaatcatcggcggaaatcgctgattcaagttctgactgaagctgttcatatgatatactgtaagcaaacgacaaacggcatcatagtatgccgtttgttttggaatagacagacttttaacagctgtttcatttgaatgaggtgaacaggcaatgaacccgggtcaagaccgagaaaaaatcgttaacattgaagagcggatccctaaaattaaagagcagaggaaacaaaaggcaaaccgccgtctcatttcatttattatgctcttttttattatggtgctgatcattgtgtacctgcaaacaccaatcagtaaagtatcaacaatctctgttacagggaatgaaaatgtatcaaaaaaggaaattatcgacctttccgatattaatagcggagatactgagttttggagtttggacaagcaaaaaacagaaaagaagattcagcaaaataaattagtgaaaaaagcggagatcagcaaatcgcttcctaataaaatcaacattgcaatcgaagaatataaagcgattgcttatttagaaaaagacgatgtgtactatgaagtgcttgaaaacggctcagttctgccaaacgaagtaacgccagatgatgccggaccgattttagtgaattggacaaacgcgaagaagcggtctcaaatggccaagcagctcgatgcgttgtcaaattcgttaaaacagtcgatttcagaaatttattatacgcctgtaaaaatggatgaaaaccgtattaagttgtacatgaacgacggttatgttgttactgcatctattaaaacgtttgcagaccgaatgaagacgtatccttctatcatctcacagctaagcagcaataaaaaaggaatcattcatttagaagttgccacctattttgaagagtttggaaaaaacgataaagctgctaaaaaggaagatgaaaattgaggggcaaatcagcagtccttctttccttgattatgcttatcgcaggctttttgatttcattttcttttcaaatgacaaaagaaaacaacaaaagcgcggctgagacggaagagtggaaaaaagaatatgcgctgagagatgaacttctgaaacaagagaaagaaaataagaagcttgaaaaagaattatatcaaaagcaaaacaaagtccgccaggcggaaaataagctgaagaaagagaagacggaatactataatgtcctcgaagatacagaaaaatacaggatgtatattggggaagtcggtgtgcagggagaaggcgttgaggtgacattggaagatgcgtcatacatacctgaaggggagaatgtgaatagttacatcgttcacgaaagccatatcttccaagtagtaaacgaactgtatatctcaggagcggcggctgtcgccgttaatgggcagcgtttgacgcatgattcgtatatcaaatgcaatggtcctgtggtaacggtagacggggtgcagcatcccgctccgtttacggtatccgctattggagatccagatgtcctgctgccctcgttaaatatcgcaggaggcctaattgatcagctgtcaatggatcatatttctgtttcggcagaaaaagagaaaaatgtacaaatgaaaccgattctgaaaacgaaggaatgactgaaaaagcgggtgaaatagattgaaaataaagcgttccttcataagcatcagtgtgcttatggtcatcttcggcctgatgatatctgttcagtttaattcgttaaaacaccccaaagtccgggatacaagagatatgtgggatattagggaagagctgacatcagagcagaagaagcaggaaaagctgctggctgaaataaacaaatatgacaaactgctgaatagctattcgcaaacgaaagaaatgacaaaagaaaccgcgctaaataataccttgcaatccttaaaaaaaacagccggcatgaccgatataacaggtagcggaattgtcattacgatttccccgcttttttctgaaagcttaacaggagagccgatcgaaaatccgcctccggatttgctgaaaaagctgattaatgaactcaactcctacggtgcagagcatatctcgattaacgagcgaagagttgtgaatcatacagtcatcagagatataaacggcactacaaaaatagacggatacgcccttgacgattatcctttaacagtaaaagtgcttgccaaagatccggacatgttacacagcagagtgaaggggtcaggccttgaggatctttttgcatctgaaaatttagcattaaaagccggtaaatctgaaagcaaactaacattaaaagcatatgacagaccactggacgtacaacagctgaaactgcttaaagactgaaaaggaggagaattgtcatgtggctgcccgtgttgggactggtgctcggaatagcgattggactaatgacaaacttaacgataccgagtgaatactcaaactatttatcgcttgcggtgcttgccgcacttgatacattaatcggtggaatcagggcgcatttacaaggtacatatgatgaaatggtatttgtttccggtttcttttttaatattatattggcaataagtttagcttttctgggagtccatcttggtgtagacttgtatttagcaggtatattcgcatttggagtcagattatttcagaatatagccgttatcagaagaaatctactaacaaagtggactctttctaaaaaaaataaaaaaaatgtgatataaaagaggatatacataggatataacgaatattttcaataaacataaaatgtgaaaagcacataaaaatattctgttgttattttttgttacacacttgtaaagccacattcattgtattgttgttccgcaaataatagaatagaaatgatcgaaatgtgaggaggtgccatagaatgaacaacaatgaactttacgtcagtcttgacatcggtacgtccaatacaaaagtgatcgtcggagaaatgacagatgattcccttaatattatcggtgtgggaaatgtaccgtctgaagggttgaaaaaaggctcaatcgttgatatagatgagaccgttcattctataagaaaagcgtttgaccaagctgaaagaatggtaggttttccgcttagaaaagctattgtcggcgttaatggaaattatatcaatattcaagatacaaacggtgttgtagcagtttccagtgaaaataaagaaattcaggttgaagacgtacgccgtgtcatggaggcggcacaggttgtttcagtaccgcacgaacagctgattgtcgatgtcattcctaaacagtttatcgtagatggaagagatgaaatcaccgacccgaaaaaaatgctgggggtgcgtttagaagtagagggcaccttgatcaccggttcaaaaacaatcttacataatttactccgctgcgttgaaagagctggtattgaaataactgatatttgccttcagccgctggcagccggttctgctgcattatcaaaggacgagaaaaaccttggtgtggctctcattgatatagggggagggtcaacaaccattgccgtattccagaacggacatctcacttctacccgtgtcattcctctcggaggcgaaaatatcaccaaagatatctccatcggattgagaacgtcaacagaagaagcagaacgcgtgaaaaagcaatttggacatgcctactatgacgaagcctcggaagatgaaatatttgaggtaaccgttataggcaccaatcaaaaacaaacatttacacagcaagaagcagcgaatatcattgaagcgagagtagaagaaattcttgaaattgtttcagaagagcttcgcagtatgggaattaccgatctgccgggaggcttcgtgctgacaggaggacaagcagctatgccgggtgtcatgtctttggcacaggatgtgctgcaaaacaatgtcagagtggcaagcccgaattatatcggtgtaagagatcctcaatatatgacgggagtgggcctgatccaattcgcctgccggaatgcaagaatccaaggcagaaaaataggctttaagatgcctgaagaagcgatacaggaaatcgcagtctcatcatctgaggaacaagagcagcatcatcaccaaaatgaggtgcagcagcggccaaaaggaaaacaaaaaacacaagccgaacataataaacagagcaaaatgaaaaaactattaagcatgttttgggaatagatagatagtcattcggcagattaggaggatttagcatgttggagttcgaaacaaacatagacggcttagcatcaattaaagtaatcggagtaggaggcggcggaaacaacgccgttaaccgaatgattgaaaatgaagtgcaaggagtagagtatatcgcggtaaacacggacgctcaagctcttaacctgtcaaaagcagaagtgaaaatgcaaatcggcgcaaagctgactagaggattgggagcaggtgcgaatccggaagtcgggaaaaaagccgctgaagaaagcaaagagcagattgaagaagcacttaaaggtgctgacatggtattcgtgacagctggtatgggcggcggaacaggaacaggtgccgcaccggttatcgcacaaatcgcgaaagacttaggcgcattaactgtcggcgttgtgacaagaccgtttaccttcgaaggacgcaaaagacagcttcaggctgcaggcggaatctcggcaatgaaagaagcggtggatacactgatcgtgatcccgaacgaccgtatccttgaaattgttgataaaaacacaccgatgcttgaagcattccgtgaagcggataacgtacttcgccaaggggttcaaggtatttctgacttgattgctacacctggtcttatcaaccttgactttgctgatgtgaaaacaatcatgtcaaacaaaggatctgctttgatgggtatcggtattgctactggggaaaatcgcgcggcagaggcagcaaaaaaagcaatttccagcccgcttcttgaagcggccattgacggtgcgcaaggtgtcctcatgaacatcactgggggaactaacctcagcctatatgaggttcaggaagcagcagacattgtcgcttcggcatctgatcaagacgtaaacatgattttcggttctgttattaatgaaaatctaaaagatgagattgtggtgacagtgattgcaaccggctttatcgaacaagagaaggacgtgacgaagcctcagcgtccaagcttaaatcaaagcatcaaaacacacaaccaaagtgttccgaagcgtgagccaaaacgtgaggagcctcagcagcagaatacagtaagccgtcatacttcacagccggctgatgatacgcttgacatcccgacattcttaagaaaccgtaataaacgcggctaatgtaaaggacaaaatcgttttcgattttgtccttttttgtttttctcttcacactttccttcttataaagtctttttccctattgcttccttcgcttagtaacaaaacagataattagacctatttatttttgtgacatttttatcattttcatatatatggaaattgaatgacatgaaacgacaatatctgtaattcagattgtctacagttaatatacagcgatgttctgacaaaccattcattattaaaaggagggacgacactttttttaaaaagcatgttgaaaaaggggatgaaaatgaagaaaaaaacgaaaaacagactcatcagctctgttttaagtacagttgtcatcagttcactgctgtttccgggagcagccggggcaagcagtaaagtcacctcaccttctgttaaaaaggagcttcaatctgcggaatccattcaaaacaagatttcgagttcattaaagaaaagctttaaaaagaaagaaaaaacgacttttctgattaaatttaaagatcaggctaacacagaaaaagcggcaaaagcggctgttaaaaaagcgaaatcgaagaagctgtctgccgctaaggcggaatatcaaaagcgttctgctgttgtgtcatctttaaaagtcacagccgatgaatcccagcaagatgtcctaaaatacttgaacacccagaaagataaaggaaatgcagaccaaattcattcttattatgtggtgaacgggattgctgttcatgcctcaaaagaggttatggaaaaagtggcgcagtttcccgaagtggaaaaggtgcttcctaatgagaaacggcagctttttaagtcatcctccccatttaatatgaaaaaagcacagaaagctattaaagcaactgacggtgtggaatggaatgtagaccaaatcgatgccccaaaagcttgggcacttggatatgatggaactggcacggttgttgcgtccattgataccggggtggaatggaatcatccggcattaaaagagaaatatcgcggatataatccggaaaatcctaatgagcctgaaaatgaaatgaactggtatgatgccgtagcaggagaagcaagcccttatgatgatttggctcatggaacccatgtgacaggcacgatggtgggctctgaacctgatggaacaaatcaaatcggtgtagcgcctggcgcaaaatggattgctgttaaagcgttctctgaagatggcggcactgatgctgacattttggaagctggtgaatgggttttagcaccaaaggacgcggaaggaaatccccacccggaaatggctcctgatgttgtcaataactcatggggagggggctctggacttgatgaatggtacagagacatggtcaatgcctggcgtgcggccgatattttcccagagttttcagcggggaatacggatctctttattcccggcgggcctggttctatcgcaaatccggcaaactatccagaatcgtttgcaactggagcgactgatatcaataaaaagctcgctgacttttctcttcaagggccatctccatatgatgaaacaaagccggaaatatctgcaccgggcgtaaatattcgttcatccgttcccggtcagacatatgaggatggatgggacggcacatcaatggcagggccgcatgtatccgctgttgctgcactgctaaaacaggcgaatgcctcactttctgttgatgagatggaggatatattaaccagcacggctgaaccgctcacggattcaacatttcctgattcaccgaataacggatatggccatggtctggtgaatgcttttgatgctgtatccgctgttacagatggtttagggaaagcggaaggacaagtttctgtagagggggatgaccaagagcctcctgtctatcagcatgagaaagtaactgaagcctatgaaggcggcagcctgccattgacattgacagctgaagacaatgtgagtgtgacgtctgtaaagctgtcctacaagcttgatcaaggtgaatggacagaaataacggctaaacgaatcagcggtgatcatctaaaaggaacgtatcaggcagagatcccagatataaaaggaactaaactaagctataagtggatgattcacgattttggcggtcatgtggtttcgtctgacatatacgatgtaacagtgaaaccaagcatcacggcgggatataagcaggactttgaaactgcacccggcggctgggttgcgagcggaacaaataataactgggaatggggagttccgtcaactggcccaaatacagcagcatccggagaaaaagtatatggaacgaatttgacaggaaattatgccaactcagcaaacatgaaccttgttatgcctcctgttaaagtacctgattcaggaagtttgtttcttcaatttaaaagctggcacaatttagaggatgattttgattacggctacgtttttgttcttccggaaggtgaaaagaattgggagcaggctggtgtctataacggaaagacatcaagctggacggaagaagaaattgatttatcggcttataaaggccaaaacattcaagtgatgtttaaccttcaatcagatgaaagcattgcaaaagagggctggtacattgatgatgtagtgctttctgacaaatcagccggaaaaacagtcaaaaagaataagctgggcgtcgaaaagccgtctggaaagcaaaagaaaaagccagtaaatccgaaaaaggctaagccatctgcaaacacagcggtaaaacatcagaacaaggctatacagcctcaagttttgccgctcagggcacaagtcagtgtagtggaaacaggaaaatcaacatattcagatcaatccacagggcagtacacgctgaagcacaaagcgggagactatacgcttatggcagaagcatatggttatcagtcgaaaacacaaaaagtgtctttaaagacggatcagacgacacaagctaattttacgttagaagagatgaagaagggcacattaaaaggcacggtcatcaataaaacgacaggagagccggtaaaaggcgcttccgtttatgttgtagaggatgctgcggtggaaccggctatgacaaacgataaaggtgaatatacgctggaggcctatgaaggcgcttatacgattaaagtcgctgcaccgggttattacagtgatgaattttccgttgagttaaaaggtgatgttacaaaagaaactgcattgaagcctttcgtcggttatccgggtgaaattgcatatgatgacggaacagcggagaatgccaattcctattttgctgccggtaacggatgggcggtaaaaatgacgctggctgacggcaaggacaaaggcatgcttacaggagggctgttcagattctgggatacagagttcccagatccaggcggtacagagtttaaggttgaggtatatgatgctacaggaaaagacggagcaccgggcaagaaaattgccgggccatttaacgctgaagctcttcgcaatggcgagtggactaaggtagatctcagttcaaaagggattatggtcgataaagacttttatctcgtatatatccagtcgaaacctgacccgtattcacctggactggcaatggatgaaaccggcaagaattccggccgcaactggcagtatataggtggacaatgggagccgggtgacgaagcagacggcaactatatgattcgcgcattagttaattatgaagctgctgtacctgagattacttcaccgacagacaaatcatacacaaataaggatagcgtcactgtaaaaggaaacgcttctcctggtacaacggtacacatttataatggagagaaagaggcaggagaaacgaaagctgctgcggatggcacgttccatgcaggcatcacactcaacaagggtgaaaatgagctgacggcaactgcagcaactgacaacggaacaacagatgcctccagcccaatcacggtcacgcttgatcaagaaaagcctgagttaacgctggacactccaaaggatggcgggaaaacaaataaagaaacgctgactgtcaaaggggctgtatccgatgacaatctgaaagacgtcaaggtgaatggcaaaaaagcaacaataaccgatggttcatactcagcccggattcttttggagaatggaagcaatgaaatcaaggtgattgctacagacttagcaggcaacaaaacgacgaaaaaggctgtcattgatgtcaattttgataagcctgtcatttccggcttaattccgggagaggataaaaacttaaaagccggtgaatctgtgaaaatcgctttctcaagcgctgaggatttagatgcaacgtttatcattcgtatgccgctgaccaatgcaagagcgagtgtgcaaaatgccaccgaactcccgttaagagaaatttctccgggaagatatgaaggctattggacagccacttcttctattaaagcaaaaggagcaaaagtagaagtgatcgtacgagatgattatggaaatgaaacaagaaaaactgcgaatggaaaacttaatatcaacacagaaaattaagtggaaaaaaagctgccgtcattggcagcttttttatatatcctctcattacacttcctcgacaaattaagcagatttccctgaaaaattgtattttcctctcaacattaattgacagactttcccacagagcttgctttatacttatgaagcaagaaggggaacagcgtgaggcaagaaagaaaggagtcagatgtgaaaatctatttagatgtcatttggctgttaaacttttgttttgatgcacttttgcttttgctcacggcatttattttaaaaaggcatgtaaaaaaagaagactggtaggcggagcgttcatcggttccagtattgtccttttgatgtttactcctttttcgccgattgttgaacatccggctgggaagctagctttttcagttgtgattgtggtggtgacatttggctttaaaagatttcggtttttctttcaaaatttgttttccttttattttgccacttttttaatggggggaggaattataggagcccattctttgctgcagtcaaattctattgttcaaaacggtgtcatgattaccaatcaaacagggtttggagacccgatcagctggctgtttattgttggtggctttccagcattatggtttttttctaaaagaagaattgaagatattgaaacaaaaaacattcaatatgaggaacgagtcagcgtgcaggcagatttgggcagccaaacacttcatgtcagaggcctgattgattccggtaatcagctgtacgatcctcttacaaaaacaccggtaatgatcatttacattgataaactggagccgattttcggaacagccgaaacgatgatcattcgaaacacagacccattggaagccatcgaacagctcgatgattcctttcgctttttagataaaatgaggttgattccatacaggggagttggtcagcaaaatcaatttttattatgcgttaaaccggatcacgtaacgattatgacaaaagaagaaatgatctctgcagataaatgtttaatcggcatcagcacaacaaagctgtcggcagatggagagtttgacgcgattattcatccgaaaatgctttcgggcaaggctgtcaaacacgtttcataatgttcgcaaatgtccgttacttatcatactcaaacggcgtgacatttagaagggagaggaagatgaaaaaactgaaattacggttgacgcacctctggtataagctgctgatgaaacttgggctgaaaagtgatgaagtctattacataggcgggagtgaagccctgccgcctccattatctaaagatgaggagcaggttttgttaatgaagctcccaaacggcgatcaggcggcgcgcgccattctaattgaacgcaatttgcgtctggtcgtatatatcgcccgtaaatttgaaaatacgggaattaatatagaggatttaatcagcatcggtaccatcggtctaatcaaagctgtgaatacattcaatccagaaaagaaaatcaagcttgctacctatgcctcccggtgtatagaaaatgaaatcctgatgtatttaagaagaaataacaaaatccgttcagaggtttcctttgatgaaccgcttaatattgattgggacggcaatgagcttttgctttctgatgtgctcggcactgacgatgacatcatcactaaagacatagaagctaacgtcgataaaaagcttttgaaaaaagcgcttgaacagcttaatgagagagaaaagcaaatcatggagctgcggtttgggcttgtcggtgaagaagaaaaaacccaaaaggatgtagcggatatgatggggatttctcagtcttatatttcgcggcttgagaaaagaattataaaaagattgagaaaagagttcaacaaaatggtgtaaaaaaatttatggttagaaccccttgattttacagggatttcctgatttcgacagtttttcggtctgagtgcagtgcatatttttcccacccaaggagatacttaacgttgtacagcagctcctgtagggagggaaaaaagtgtcgagaaataaagtcgaaatctgcggggtggatacctccaaattaccagtactcaagaatgaagagatgagaaagctgtttagacagctgcaggatgaaggcgatgattcagcaagagaaaagcttgtaaacgggaacttgcgtcttgtcttaagtgtcattcaacgatttaataacagaggggagtatgttgatgacttatttcaagtcggctgcatcggactaatgaaatccattgataattttgacctaagccacaatgttaagttttcaacatacgctgtacctatgattatcggagagatccgcaggtatttacgcgataataacccgatccgtgtctcaagatcactccgggacatcgcttacaaggcgcttcaggtaagagagcggttaatcagtgagacaagcaaggagccgactgcagaagacatcgcaaaagttcttgaagtaccgcatgaggaaattgtatttgcgcttgatgccatccaggatccggtttctctatttgaaccgatctataacgacggcggagacccgatctatgtgatggaccaaatcagtgatgagcgtaatacagattcacaatggattgaagagctggctttaaaagagggcatgagaaggctgaacgatagggaaaaaatgattttgagaaagcgattcttccaagggaaaacccaaatggaagtcgccgaggaaatcggaatttcccaggcgcaggtgtccagacttgaaaaagcggctatcaaacaaatgaataaaaatattcatcaataatgaaaagcctttaaaacgatgttgttttaaaggcttttctattgattacggatggtttacgttttggaaaaagtaaggtatcctagttcgtacaaagttttatgaaaattaaaacaattataaaaggcaataaagaggaggaccacgatgattttgcagcttgacaatgtctcactaaaacggaatgggaaatggatactgagagatattcattggaaggtggaagaaaaggaaaattgggtgctttacggcctaaatggcgccgggaagacagcgctgttaaatatgctttgttcatattattttccaacatcaggcgagatgcaggtgcttggccatgaatttggcaaaacagagcttggggaaaagctcagacgtaaaattggcctcgtctcagcagctcttcagcaaaaattgtatccggcagattcagcctttgaaattgctttgagcggagcttacgcttcgattgggttatatgaaacgccaagtaaggaaaccagggaaaaagcgattggtttgttagaggacttgggagcaattgaatatgccgatcgccgctatgaaaccctttctcaaggggaaaaacaaagagcgttgattgctagagcactaatggccgatccggagttgctgatactggatgaaccagtcacagggctggattttattgcccgggaaaagttgttagatacgattacatacattgcaaacaaagaaaatgcaccatctatcctttatgtgactcatcatgctgaagaaattttacctgtctttgataaagcccttttattaaaacagggagaggtctttggatccggagaaataaaggaaatgcttactgatcaaatactttccgctttttttgatatgccaatccatgtattatggaatcaggatcggccgtttttaacaagagctgagccgataacgaatgcctgacaaacatatatagattcatcctaggggtgctttacgaagctgagagagactttgtctcaacccttttgacctgatctggatcatgccagcggagggaagcggtgaaaagcggagtacatcggactccgtttgtttttattaagccgtttcatcacatttgaaacggcttttttgattttaaagaataggagcggatttacattggatcaacaaatagactctttgcaaaaaaaagtggaagaacaaaaggaggagcttattcagcttgctaaaacactgatttcttatcaaacacccgctccgcctgcaagaaatacagagggcattcagtcatggattgcgggatttttaaatgaattgggattctcgatcgacaaatgggatgtgtaccctggagatcccaatgttgtcggcaagctaaagggaacagattcagcagattattatagcctgattatcaatggtcatgtagatgtggcagaggtaaaagaggatgaagaatggaagcacgatccgtttcatcccattgaaaaaaacggtctcttaatcgggcgaggcgcttccgatatgaagggcggaatggcttgtgtgctgtttgctgtcaaattatttcgtgaagccggcattgagcttccaggtgatctgattctgcaatcggttattggggaggaagttggagaggccggcacacttgaatgctgcaagaggggctaccacgctgattttgcaattgtcgcggatacgagcgatatgcatattcaaggccaaggcggtgtcattacaggctggatcgaaatcaaaagcagtcaaacatttcatgatggaacgagacggaatatgattcatgcaggcggaggaacattcggagcaagcgcaattgaaaaaatggcaaaaatcattgcggggctcggtgaacttgagcgccactggtctattatgaaaagttatcccggttttaaacccggcacaaatacgattaacccggcagttatagaaggcggcagacatgcggcttttatagcggacggatgccggctgtggatcacagtccatttttatccgaatgaaacccatgaccaagtggcagcggaaatagaagattacgtcaatcggctgagtgacagtgatatttggcttagggaaaaccgccctgtattcaagtggggaggctcatctatgatagaagacagaggagaaatttttccggcattggaagttgaccctggccacccaggcgtcttagcgctaactgcctctcatgagaaagtgaaacgggagtgtccaattattgacgtttctcaatcagttacagatggcggatggctgtatgatgccggtattccatgcgtaatatacggtcctggagatctgcacaatgcacactctgtgaacgagaaggtatcgattgagcagctagtagagtatacaaaaattatactcgattttatcatcagctggtgcagccggaaaaaagaacaatgacatgaaaatttcttcttgctgacaaggttcagcctgcccgttcatatacttgaacaaaaggacggaaaaaggacgtgatggaatgatcagcatttcagaatttcaggtaaaggatgtcgtcaatgtctcaaacggaaaaaagctggggagtattggtgatattgatatcaatgtgactactggaaaaattcaggcgatcatactcggaggaaatgggaaagttctcggattttttggaaaagaagaggaattggtcattccatggcgaaatatagtaaaaatcggggaagatgtaatcttagtccgattaagtgaaccgcatgcataaacctgcttctctgccgcagattggcaaatgccggaagtctcgattcttccggcacatttcatttagaaatatgcaaatcggcgctcaacgaatgcagtaagatgtggtaaaataagtgggaaattccgcttttttaaatgtttgtcgaaaggttggatcatcatgaatacatatcacccattcagtcttaccacaccctcgacactcatgatacaagactgggctcaaacgaatcaaaacaacaaagaggtcattgccggatttacgacaaaaaacggcggtgtcagccaaaagccttttgaatcgttaaatacaggattgcacgttcatgacaaagatgcagatgtagttaaaaatcgtgaatatattgccgatatgtttaatactgatttgcagtcttgggtattcgctgatcagacacatgataatcgcgttcagaaagtgacgcagagggataggggaaaaggcacccgtgagtatcacacggctctaaaagcaacggacgggctctatacaaatgaaaaaaatgtatttttagcattatgctttgctgattgtgtgcctcttttcttttatgatccggttaagtcgcttgtcggagtcgcccatgccgggtggaaaggcaccgtcaaacagattggcagagaaatggtgaagcaatggactgagaaggaaggttcaaatccctcagatatttacgctgttattggcccgtctatcagcggagcatgctatacggtagacgaccgcgtcatggatgctgttcgtgcattgccggtttcagcagaccttgccgccaatcagacggcaaaggcacaatatcagcttgatctgaaagagctgaaccgtcttatactgatggacagcggtttggcaagtgaacaaatttctgtcagcggtttatgcacggaaagcgagccgtctcttttctattctcatcgccgcgatcaggggaaaactggacggatgatgtcctttatcggaatgaaggaggcataaaagatcttgcgtgttgttgataatttacgacatataaacgaacgaataaacgaagcatgtaacagatcgggccgcagctccgatgaagttacggttattgcagtcacaaaatatgtatcacctgaaagagcacaggaggcagtagatgctggcatcacctgcctcggagagaatcgggatgcggaactgctccgcaaacaggaattgatgaaagggaatccggaatggcattttatcggcagtttgcaatcaagaaaagcaaaatctgtcgtcaatgcggtttcctatatccattccctagaccggctctcattagcgaaagaaattgaaaaacgggctgaaggtactgtacgatgctttgtgcaggtcaatacctctcttgagccttctaaacacggcatgaaaaaagaagaagtcattccattcatacaggagctttccggtttcgaacatatccttgttgccggactgatgacaatggctccgctgactgatgatcaagatcagatcagaagctgtttcaggtcgctgagagaactccgtgaccaggttcagaagctgaaccagccgaacgctccgtgtactgaactgtcgatgggcatgtcaaatgattttgaaattgcaattgaagaaggagctacttatattagaatcggctcatcgttagtcggaaatgaaacaggggtgtacagcaatgagtatgaaaaataaactgaaaaactttttctcaatggaagatgaagaatacgaatatgaatatattgagacagagcgggaatctcatgaggagcatgagcaaaaagaaaagccggcttatacggggaataaaccttcgggcaaacagaatgtagtgagcttgcaaagtgttcagaaatcctctaaagtggtgttgagtgagccgcgcgtttatgcggaggcgcaggaaatagccgaccatttgaagaaccggcgggcagttgtcgtcaatcttcagcggatacagcatgaccaggcgaagcggattgttgactttttaagcggaaccgtttatgccatcggcggcgatattcaaagaatcggctcagatattttcctctgcacgcctgacaacgtagatgtatcaggcacaatttctgagctcatatctgaagacgaacatcagaggtggtaaagcgagatgatcctttatcaagttttttcggttttaagcttattaatcacaatatactcatttgccctgatcatatatatttttatgtcatgggtgccgagtacgagggaaacagcagtcgggcgttttttggcttcgatttgtgaaccatatctcgaaccattcagaaaaatcatccctccgattgcaatgctggatatttcaccaatcgtagcaatacttgtgcttcggtttgcgacaaccggcttgtggggactttatcgcatgattgcgttttaatgtgacagtttgatagtggcttggcagcagccaagcctctttacatagaagggaaagacgatgagcgatatatatcagcacttcagaaaagacgagcgggcctttattgatcaggcgctcgaatggaaaagaattgtccaggagcagtaccggatgaagctgaccgactttttagacccccgagagcaggtcatcctctctgctgttacgggacaggcagatgtcgggcttgctttttccggcggttatgacagagcggagcggaaacgggcgattctgtttccagagtacattactccggaagaatcagattttgaactgcaggcgtttaacgtccgttatgctgacaagtttgtctcagtagatcatcgttctctgcttggtgcattaatgggcataggattaaagcggcaaaaattcggtgacatcgtgttttctgagacagcagtgcaattgattgtctcagccgataccgctgattttgtggctgcacagctgatccaagcaggcaaagcggcggtcagcctagagaaaattgacttgtcagaccttaacattccagcagttgatgtcgaaataagagatgacacggtttcttctttaaggcttgacgccgtctgcgcctctatgagcaggcaatcccgccagaaatcacagacgcttgtgaaaaacggccttgtgaaagtgaactggaaggtggttgaagatccttcatacatagtcgcggaaggggacatgctgtcaatcagaggttttggccggtgcagcttaacaaaaatcgaaggaaaaaccaaaaaagacaaatggagagttacgtttgaacgacaaaaatagtcggtttttcagtttttttctccatctgtgcgaaatttgttttataatgtgaactagataaccgtactgaaatgtaaaaatggaggtggcatcatgccattaacgccaaatgatattcacaacaagacgtttacaaaaagttttcgcggatatgatgaagatgaagtaaatgaattcctagcccaagtcagaaaagattacgaaattgttctccgcaagaaaactgagcttgaagcgaaagtcaatgagcttgatgaaagaatcggacactttgccaatattgaggagacattgaataaatcaattttagttgctcaagaagcggctgaagacgtaaaacgcaattctcaaaaagaagcaaagctgatcgttcgggaagcggagaaaaacgctgatcgcattatcaacgaatcgttatcaaaatcaagaaaaattgcaatggaaattgaagagctgaaaaaacagtctaaagtgttcagaacacgtttccaaatgctgattgaagctcagcttgatcttctgaaaaatgacgattgggatcatctccttgagtatgaagtcgacgctgtatttgaggaaaaggaataaattctctgattatcttgacattttcttagcttgtcgaatataatacgttcataaattcagatgaaaaaacggttgaaagggacagtcatgtttccttcaggccttcatagcgacccggagatggtgagagtccgggatggccggaatcatgtagatcagccctttagtttccttgctgaactcacagtaggttaggacgttcatcacgttacgatgctcaagaggaaaaagtgtatgcttgctttttctaaaagggtggtaccgcgagataagctttctcgtcccttatgggatgagagggctttttttattttctgaaaaaatgcagtggaggaatgaaaatggattttaaagacacgctcttaatgccgaaaacagatttcccgatgcgtggaaatttgccaaaccgtgagcctgacattcaaaaaaaatgggaggaagaagatatctaccgtcttgttcaggaacggacgaaagaccgcccgaaatttgttttacatgacggacctccgtatgcaaacggcgacatccatatgggccatgcacttaacaagattttgaaagacttcattgtccgctataaatcaatgagcggctacaacgcaccgtatgtgccgggctgggatacacacggattgccaattgaaacagctctgacaaaaaacaaaaaggtcaaccgcaaagaaatgtcagtagcggaattccgcaaactgtgcgaagagtacgcttggaagcaaatcgagggacagcgtgagcaattcaaacgtcttggtgtccgcggtgactgggaaaacccatatgtgacattaaaaccggaatacgaagcgcagcaaatccgcgtatttggtgaaatggcaaaacgaggctacatttacaaaggccttaaaccggttaactggtcaccttcaagtgagtctgctctggctgaagccgagatcgaatatcaagacaaacgttcagcatctatttacgtcgcttttggtgtaaaagacggaaaaggcgttcttgaaaatggcgagcgcatcattatttggacaacaacgccttggacaattccggcgaacctcggaatttcagtgcaccctgatcttgagtacagcgtgattgcagtaggtgaagaccgctttgtcgtagcaagtgccttagtcgaaaatgttgcattggcatgcggatttgatcagtatgaagtgacaagaacggtcaaaggaaaagaccttgagaacattatcgctgaacacccgctatatggcagagactctctcgttatgcttggtgaacacgtaacaactgatgccggaacaggctgtgttcatacagcgcctggacatggggaagatgactttatcatcggccaaaaatacggtttagatgtgctttgcccggtcgatgaaaaaggtgtaatgacaagcgaagcccctggctttgaaggcatgttctatgatgatgcaaacaaagcgatcacacagcagcttgatgaaaaaggcgcacttgtgaagcttgaattcattactcactcttatccgcatgattggagaacaaaaaaaccaaccattttcagagcgacagcgcaatggtttgcgtctattaaagatttcagatcagacctgctggatgccattaaagaaaccaaatgggttcctgaatggggcgagcagcgtttgcacaacatggttcgggaccgcggagactggtgtatttccagacagcgtgcgtggggtgtgccgattccggtattttacgctgaaaacggagaaccgattattacagatgaaaccattgaacatgtttctgaattgttcagacagcacggatcaaacatttggtttgaaaaagaagcaaaggatcttcttccggaaggctttacgcatcctggcagcccgaacggcacatttacaaaagaacaggatatcatggatgtttggtttgattcaggctcttcacatcaagcagtgcttgaagaacgtgatgacctcgttcgcccggctgatttatacttagagggatctgaccaatatcgcggctggtttaactcttctctttctacagcagtagccgtaacagggaaagcgccgtataaaggtgtgctcagccatgggttcgcactggatggagaaggacgcaagatgagtaaatcaatcggtaacgttgttgttccggctaaagttatgaaacagcttggtgccgacatcttaagattatgggtatcttcagtggattatcaggcggacgttcgcgtgtctgacgccattctgaagcaggttgcggaagtatatcgtaaaatccgcaacacgttccgtttccttcacggcaaccttttcgattttgatccaaaaacaaatgcggtggctgtcgaagatcttcgcgaagtggatcagtatatgctgattaagctgaacaagctgattgataaagtgaaaaaagcgtatgatgagtacgaatttgcggttgtgtatcacagcattcataatttctgcacaatcgaattgagctcattctaccttgattttgcaaaagatattgtctacatcgagcatgcggatcatccggatagacgcagcatgcagacagtattctacgaaacgcttcttgcattagtgaagctttcagcgcctatccttccacatacggcagacgaattgtggtctcatttaacatttgttgaagagcagagcgttcagctgaccgatatgccggaaacaatcgcggttccaaacagtgaagcgactgaagaaaaatttgaccgctttatggctcttcgtgatgacgtgttaaaagcattagaaactgcgcgaaatgaaaaaattatcggtaaatctttggaagcaaacctgaaattgtatccaaacaaagaaaacaaggagctcttggcttccataaaagaaaacctttctcagctgtttattgtgtctgaactgacaatcagcgaagaaaatgaagcgccgaacgatgcgcaaagctttgcgacaggtaaaatcgctgtcgagaaagctgaaggcgaaatgtgtgagagatctcgtgtgatttcaaaagatgtaggggcaaatccgaaatatcctacactttcattacgcaacgctgaaatcgttgaaaaatactatcaaaaataatgcaaaagagcccggcttaaaagccgggctttttttgtgccaagagtgacatcctttagaacgacaggaaaaatcttatgggctttagatcatcattcgcaggcaacaataaagatactacgttaagagcaggagttgtgaagaatgaatgatcaactgaccgcaatttatacggaacttcttctgatgaaagaagaattacagtccagattatttgagtattcttgctttcaggtttctacaagcccgcaagcagcaatcaatcaaaaacaaaaagcaactctgatctatcatattaaagaagaacttcaagacgttctccttgcattgtccaaaatcgaaaacggcacattcggatactgtgaagaaaccggggctcccattcctcttgcaaagctggcagtgctgccgacggcccgaacagcaaacgattttctttattctgtccaatttgagaaaaaaacgcttccgatatggaaatcaacggatatcgaatatggtcaggcactgtatgaataacagtgtctggccggttattatgcctgatatttctttactccagtgctttttattgataaaatgcataatggattaaagtaaccgtaaactggaggaacgtttgtgctgtattatatgattgcactacttattattgcagccgatcaattgacaaaatggctagttgttaagaacatggaacttggccaaagcattccgatcattgatcaggtattctatatcacctcccatcgcaatacgggtgctgcatgggggatattagcgggtcagatgtggtttttctacctcataacaaccgctgttattattggtattgtttattacatacagcgttatacaaaaggacaaaggcttcttggtgttgccctcggacttatgcttggcggtgccatcggcaactttatcgatcgggctgtcagacaggaagttgtggattttatccatgttattattgtcaattacaattacccgatatttaacatcgcggactcttcactatgtgtcggcgtaatgcttttatttatacaaatgctgttggacagcgggaaaaagaaaaaggagcaatagcatgaatcaaattgatataaccgcttcagaagaacaaaaaagtgagcggattgataaatttttggcatcgactgagaatgattggtcaagaacccaggttcagcaatgggtaaaagacggacaggttatcgtgaacggaagcgcggtgaaagcgaattataaaattcagccgggtgatcaggtgaccgtcactgtacctgaaccggaagcgctcgacgtcctggcagagcctatggatctggatatttattatgaggaccaggatgtgctggtcgtcaacaaacctcgcggaatggttgttcacccagcacccgggcatcttacgggcacacttgtaaacggccttatggctcattgcacagacctttccggaataaatggcgtgatgcgtccgggtattgttcacagaatcgataaggacacgtccggtttattaatggtggcgaaaaatgatatggcgcacgagtcacttgtaaaccaattggtcaacaaaacggtcacgcggaaatatacggcagttgtccacgggcttatttctcacgatgatggcacaattgacgcgccgatcggacgagataagaaagaccgtcaaagcatgactgtgacacgtgatggcaaaaacgctgtcactcattttcatgtactagagcgttttcaggattttacgttagtggaatgccagcttgaaacagggagaacccatcaaattcgtgttcatatgaaatatatcggattcccattagcaggcgatccgaaatacggcccaagaaaaacaatcgactttaatggccaagcgcttcacgcgggagttttaggttttgaccatccacgaacaggagaatatgtcgaatttgaagcgccgcttcccgaggatatggcagaattaatcgaaaaccttagaaaaaacggttgacagagggtttcttttctgaaataataaacgaagctgaatagattctttaaaacagtccagagaggctgagaaggataacggatagacgggatgcgtgtacaggcgcgcaccttgtcctaaaacccctctatgctctggcaggaggggttttttcttctatatgaactgtgaggtgtcacacattgaatcaaaaagctgtcattctcgacgaacaggcaatcagacgggcgctgaccaggattgctcacgaaatgatcgaacgcaataaaggaatgaataactgcattcttgtcggcattaagacaagagggatttacctggcaaaacgccttgcggaacgcattgaacagattgagggaaatcctgttacagtcggtgaaattgatattactctttacagagacgatctttctaaaaaaacgagcaacgatgaaccgcttgtaaaaggtgcagatattccggtagatattacagatcaaaaagtcattctcgttgatgatgttctgtataccggaagaacagtcagagcaggaatggatgcgcttgttgatgtaggcagaccttcctccattcagcttgcagtgcttgtggacagaggacaccgggagctgccgatccgagcggattatatcgggaaaaacatcccgacatcaaagtctgaaaaggttatggttcagcttgatgaggtagaccaaaacgatctcgtcgccatttatgaaaacgaataatagatcacctttttaagggcaatccagagaggttgcaaagaggtgcacaacaaaggcccaaaaagtattcggcaggtctttgtatgcctctttgcgtaaaaaagcaaagaggtttttttatacagtcattgagtcatcctaaaatgaaagtcaacaatcagggggaaatcatcatgagtaagaaaaaagtaaatttaggggtcagggatgtcccgacacctttctcttgggtttcattcagccttcagcatttgtttgccatgtttggctcaaccattttggttccgaagctcgtcggaatgagtcctgctgtggcgttggtgacaagcggcatcggaacactggcgtaccttcttattacgaaagggcaaattccggcgtatctcggttcatccttcgcctttatttctccgatcattctggtaaaagcgaccggcgggccgggagcggcaatggttggagcgtttcttgcagggctggtgtacgggctgattgccttattgatcaggcagcttggaacaggatggctgatgaagattctcccgcctgtagtcgtagggcctgttattatcgtcatcgggctgggactggcaagcactgcggtaaacatggcgatgtatgctgatccaaacgcgagtgagttggtctacagcttaaagcactttagtgtcgcaggagttacgctggcaatcacgattatttgtgcgattttcttacgaggatttttaagcctgattccggttctgatcggaatcatcggcggatacctgttcgcccttactcaagggattgtcaacttccagccggtgcttgatgcgaaatggtttgcagtgcctgaatttatcattccgttcaaagattattcaccgtcagttacactcggcatcgcagccgcaatggttcctgtcgcatttgtcaccatgtcagagcatatcggccaccaaatggtgctgagcaaggttgtcggacaagatttcattaaaaagccaggtcttcatcgctctattatgggtgacagtgtggcgacaatcctcgcttccctgatcggcggtccgccgacaacgacttacggagaaaacattggcgtgctggccatcacaagagtattcagcgtctttgtcatcggaggagcggcagtgattgcctgttgcttcggctttatcggcaaaatttcagcgctgatcagttcagtgccgtcagcggtcatgggaggcgtctccttcctgctgttcggaatcattgcttcaagcggcctgagaatgctgattgacaacaaaattgattatgaaaacaacagaaacctcattattacatcagttatccttgtcatcggtgtaggaggcgcttttatccaagtatctcaaggcggattccaagtgtcaggaatggcgcttgccgcaattgtcggtgtcatcttaaacctgattcttccgcaggcgaaggaagagcagacagacacatctgaacaacatcatatctaaaaccttttaatgaaagtccagagaggcttggaagggttatgaagagaaggaagcttcaatgctgccctctatttaaccataccccgagtctatcttagaccggggtttttttcagccttaagttgaaaagagaggggaaagaacatgaagcatttaacgacgatgagtgaactcggcactgaggaaatcaaagatttgcttcaaacagcacaagaccttaaaagcggaaaaacagacaatcagcttacaggaaagtttgccgcaaacctgtttttcgaaccgagcacgagaacgcggttcagctttgaggtcgcagaaaaaaagctgggcatgaatgtgcttaaccttgatggaacaagcacaagcgtgcaaaaaggcgaaaccttatatgacacgatccggacgctcgaatcaatcggtgtggacgtctgcgtcatcaggcacagtgaggatgagtattatgaagagcttgtcagccaggtgaacattccgattctgaatgcgggagacgggtgcggccagcatccaacacaatcactgcttgatttaatgacgatttatgaagagttcaatacgttcaaagggcttaccgtctccattcacggcgacatcaagcatagcagagtggcaaggtcaaatgcggaagtgttgacaagattaggtgcccgggtcctattttccggcccttcggaatggcaggatgaagaaaatacattcggcacgtatgtctcaatagatgaagcagttgagtcttccgatgtcgtcatgctgctgcgcattcaaaatgaacgacatcagtccgctgtcagccaggaaggctatttaaacaaatacggcttgaccgtagaacgggctgagcgtatgaagcggcatgcgatcatcatgcatcctgctccggtaaacagaggagtggagattgatgacagcttagtagaaagcgaaaaatcaagaatcttcaagcaaatgcaaaatggcgtatttatcagaatggcagtgatacagcgtgccttacaaaccaatgtgaaaagaggagaagcagcatatgtcatatctcattaaaaacggctggatactaaacgaaaatggtgaaaaaacagaagcggatatccgagtgactggagaaaccatcaccgcaatcggcaagcttgatgcaacggataatgaaacggtaattgatgcaaaaggtttgctcgtttcacctgggtttgttgatctccacgtgcatttcagagagccgggtggagagaaaaaagaaactattgaaaccggggccaaagcggcggcacgcggcggctacactacagtagcagcaatgccgaatacgcggccggttcctgatacaaaggagcagatggaatgggtgcaaaacagaattaaagaaacatcatgcgtcagagttcttccatatgcatccattacgatcagacaaatcggcgatgaaatgacaaactttgaagcgttaaaagaagccgggtcatttgcttttacagatgacggcgttggtatacagacagcaggaatgatgtatgaagcgatgaaacgggcagccgcaattgacaaagcgattgttgcacattgcgaggacaactccttaatttacggaggaagcgtacatgaggggacattctccaaagcgaacgggctcaacggcataccttctgtgtgtgaatcggttcatattgcccgcgatgtgctgctggctgaggcggcaaactgccattatcatgtatgccatatcagcacgaaagaatctgtcagggttgtacgcgatgcgaaaaaagcgggaatcagagtgacagcagaagtgtcgccgcatcatttgctgctttgtgatgaggacatcccggggctggatacaaactataaaatgaatcctccgctccgcagtgcagaagacagagctgctttaattgaaggtcttttagacggaacaattgattttatcgcaacagaccatgcaccgcatacggaagaagagaaaaacacagaaatgaaactggcgccattcggaattgtcggcttagaaacagcatttccgcttctttacacacactttgtcaaaaatggcagctggtcgctaaagcagctgattgactacatgacaatcaagccatgcgaagcgttcggtctcccatatggaacattacaaacggggcaagctgcggacattacgttaatcgatttagaaaaagaagcagttatagacaaagacacgtttttatcaaaaggaaaaaatacaccattcaacggcatcagctgcaccggctggccggtcgctacaattgcggcagggaagcttgcttatgaagaggggagacttgtcaaatgaagagacgattagtactggaaaacggagcggtattcgagggggaagccttcggaagcttagaacacaacatgggagaagtcgtttttaatactgggatgacaggctatcaggaaattttatctgacccttcttactgcggacagatcgtaacattaacatacccgcttatcggaaattacggcattaaccgtgatgattttgaatctattaccccttttgtgaaagggctgatcatcaaagaattatgtgagctgccttccaactggcgttcagcatacaccttagacgagtatttaaaaatgaaaaacattcccggactccaggggattgatacaaggaagctgacaagaatgatccgcacggcaggcgcgctaaaaggaacattcgcttcatctgatgaagatatcgaagcagttctgaaaagactgaacgaaacggaattgccaagaaatcaagtatcccaagtatcagcaaaaacagcatatccgagcccgggaagaggcaaacgcatcgtcttggttgacttcggcatgaaacacggaattctaagagagctgaacaaacggaaatgtgacgtcatcgttgtgccttacaacattacagcggaagaggtgcttcagctgaaaccggacggtatcatgctttctaacggacctggagacccgaaggatgtgcctgaagcgattgaaatgattaaaggtgttcttggaaaagtgccattattcggaatatgtcttggccaccaattattcgcgctggcgtgcggggcgaatactgaaaaaatgaaattcggacacaggggctcaaaccacccggtaaaagagctggctacaggaaaagttgccttaacatctcaaaaccatggatacacagtttcgtctatcagtaaaacagaactggaagtgacgcatatcgcaattaacgacgatacgattgaagggctgaagcataaaacattgccggcatttacggttcaatatcatcccgaagcctcacctggtcctgaggatgccaaccacctatttgacagattcatcgaaatgatcgaaacaacagagaaagaaggggaagcggtatgccaaaacgcgtagacattaacaaaattttagtaatcggatctggaccgatcatcatcggccaagcagcagaatttgactatgcgggaacacaagcctgtcttgctttgaaagaagaaggttatgaagtcatccttgtcaactcaaaccctgccacgatcatgacagatacagaaatggctgaccgggtttatatcgaaccgctcacacctgaattcttgacaagaatcatcagaaaagagcgaccagatgccattcttcctacactcggaggccaaaccggtttgaatcttgcggttgagctttctgaaagaggtgttctggcagaatgcggcgtcgaagtgcttggcacaaaactgtctgcgattcagcaagctgaagaccgtgacttgttcagaacattaatgaatgaactgaatgaaccggtgcctgaaagtgagattattcactccctcgaagaagcggaaaaattcgtcagtcacattggattccctgtcattgtccgcccggcatatacattaggcggaacaggcggaggcatctgctcgaatgagacagagttaaaagaaatcgttgagaacggcttgaaattaagcccggtacaccaatgtctgcttgaaaaaagcatcgccggctataaagaaatcgagtatgaagtcatgagagacagccaggatcacgccattgtcgtttgtaacatggaaaacattgatccagttggaatccatactggagacagtattgttgtcgcgccgagccaaacgctcagtgatcgcgaatatcagctcttgcggaatgtatcgttaaaactgattcgcgcgcttggaatcgaaggcggatgtaacgtacagctcgctttagatccagacagcttccaatattacattattgaagtaaatccgcgtgtcagccgttcatctgcccttgcatcaaaagcaacggggtacccgattgcaaagctcgctgctaaaattgcagtcggactttcattagatgaaatgatgaacccggtgacaggaaaaacatatgcagcatttgaacctgctcttgactatgtcgtatccaaaattccgcgctggccgtttgataagtttgaatcagcaaacagaaagcttggcacgcaaatgaaagcgacaggtgaggtcatggcgatcggccgcacgcttgaagagtcattgctgaaggcagtgcgatcactggaagcggatgtgtatcatcttgaattgaaggatgccgctgacatttcagatgagcttcttgaaaagcgaattaaaaaggccggtgatgaacgcttattctacttagctgaagcgtacagaagaggctacacggtagaagacctccatgaattttccgctatcgatgttttcttcttgcataagctgttcggaatcgtacagtttgaaaaagaattgaaggcgaatgcgggcgatacagatgtgctgagacgggcaaaagaactcggcttctctgatcagtacatcagccgcgagtggaaaatgaaagaatctgagctttacagcttgagaaaacaagcggggattgcgccggtattcaaaatggtagatacatgtgcggcggaatttgagtcagaaacgccatacttctatagcacatatgaagaagaaaatgaatctgtcgttacagataagaaaagtgtgatggtgcttggttcgggtccgattcgaatcggtcagggtgtcgagttcgactatgcgacggttcactctgtatgggcaattaaacaagcaggctatgaagccattattgtcaataacaacccggaaaccgtttcaacagacttcagcatctcagacaagctgtattttgaaccgcttacgattgaagatgttatgcacatcattgacctcgaacagccaatgggcgttgtcgtacaatttggcggacagactgcgattaaccttgctgacgagctttctgcacgcggagtgaaaatccttggaacttcattagaagatttagaccgtgcagaagaccgggataaatttgaacaagcgcttggagaacttggtgttcctcagccgcttggcaaaacagcgacatcagttgatcaggcggtaagcatcgcgagtgatatcggttatccggtactggtgcgtccttcctatgtacttggcggccgggcgatggagattgtgtatcatgaagaggagctgcttcattacatgaaaaacgcagttaaaatcaatccgcagcaccctgtattaattgacagatacttgacaggaaaagaaattgaagtcgatgcagtatccgacggtgaaacagtcgtcattccgggaattatggagcacattgaacgtgcgggcgttcactccggagactcaatcgctgtttatccgcctcagtctctcacagaggacattaagaaaaaaattgaacaatacacgatcgcattggctaaagggctgaatattgtcggtttgctcaatattcaattcgtcttgtcgcaaggtgaggtgtacgtgctagaagtgaatccgagatcaagcagaaccgtaccgtttttaagcaaaattacgggtatcccaatggcgaatctcgcaacaaaaatcattcttggtcaaaagctggctgcgtttggctatacagagggccttcagcctgaacagcaaggtgtatttgtaaaagcgccggtcttctcctttgccaagctgagaagagtggacattacgttagggcctgaaatgaaatcaacaggtgaagtcatggggaaagattcgacacttgaaaaggcgctctacaaagccttgattgcttcaggtattcaaatcccgaactacggttccgtgctcttaacagtagctgataaggacaaagaagaagggcttgcgattgctaagcggttccacgcgatcggctacaacattttagcgacggaaggaacggcaggctacctgaaagaagcttccattccagcgaaggtcgtcggaaaaatcggccaggatggcccgaacttgcttgatgtcatcagaaacggtgaagcgcagtttgtcatcaatacgctgacaaaaggaaagcagccggcaagagacggttttagaatcagacgtgaatcagtagaaaatggtgttgcctgcctaacatctttagatacggcagaggcgatattacgagtgctggaaagcatgacattccgtgctgatcaaatgccggcagtcaacacaaatcaggaggcggcagtcactatatgaaaaaagcgtatttgacagtatgttctaaccagcaaattgcagaccgggtgtatcaaatggttctgaaaggggagcttgtccaagggtttacaaccccgggacagttccttcatcttaaagtgagcgaagcggttacgcctcttttgagaaggccgatcagcatcgcagatgtcaactttgaaaaaaatgaagtcaccatcatttatcgggtagatggggaagggacaagactcttgtcactgaagcagcagggagaacttgtggatgtcctcgggcctttgggaaatggctttcctgttaatgaagttcaacccggaaagacggctttgctggtaggaggcggagtaggtgtgccgcctctccaagagctgtcgaaacgcttgaatgaaaaaggggttaatgtcatccacgttttaggattccaatcggcaaaggatgttttttacgaggaagaatgcaggcagtacggagacacgtatgtggcaacagctgacggaagctacggggaaaccggatttgtcacagatgtgattaaacggaaaaatctagagtttgatatcctcctcagctgcgggccgacaccgatgctcaaggcgttaaaacaggaatatgcccataaagaagtatatctgtccatggaggaacgaatgggctgcggaatcggcgcatgcttcgcgtgtgtgtgccatacaaacgaaagtgagacatcctatgtaaaagtatgtctcgacgggcctgtatttaaagctcaggaggtggcgctgtaatgctagaggtgaaattgccgggacttgatttgaaaaatccaatcattcctgcatcaggctgcttcgggtttggaaaagagttttcacgtttttatgatttgtcttgtcttggagctatcatgattaaggctacgacaaaggagccgcgcttcgggaatccgacgccgcgggtagctgagactggtgctggaatgctcaatgcgatcggtctccaaaatccggggctggatagcgtgttgcatcatgagctgccgtggcttgagcagtttgatacgccgatcattgccaatgtcgcaggttctcaagtcgaggattatgttgaagtcgcagagcatatcagcaaagcgcctaatgttcatgctcttgaattgaatatttcctgcccgaatgtgaaaacaggcggaatcgcttttggcacgaatcctgaaatggctgccgatttgacaaaagcggtgaaagaggtttcggatgtacccgtttatgtgaagctttcccgaacgtggctaatatcacagaaattgccttagcgatcgaggaagcgggagcggacggtcttacgatgatcaacacactaatcggcatgagactcgatttaaaaaccggcaaaccgatattagcgaataaaacagggggactttcaggccctgctgtgaagccggttgccattcgcatggtgtatgaagtcagccaggcggtcaacatcccgattatcggaatgggaggcgtgcaaacggctgaagatgccctggaatttcttctcgcgggagcaagcgcagtcgctgtcggaacagcaaactttgtgaatccttttgcatgtccagagattattgaacagctcccatctgttttgctccaatacggctatcaatcaattgaagaatgcatcggaaggagctggaatcatgaaaaacaacctgcccatcatcgcgcttgattttgcgtcagctgaagaaacacttgcgttcttagcgccttttcagcaagaaccgttatttgtaaaggttgggatggagcttttttatcaagaagggccatctatcgtgaaacaactaaaagaaagaaactgcgagctatttttagatctaaagcttcatgacatcccgactactgtaaacaaagcgatgaagcgccttgccagtcttggagtagacctcgtcaatgttcatgctgccgggggcaaaaaaatgatgcaggcagctctcgaaggcttagaagaaggtacgccggctggaaaaaaacgtccgttacttatcgcggtaacccagctgacaagcacatctgaacaaattatgaaagatgaactgctgatcgaaaagtctctgattgatacggttgtgcactacagcaaacaggcggaagaaagcggactggatggagtggtctgctctgttcatgaagcaaaagccatttaccaagcggtgtcgccttcatttctgactgtcactccggggatcagaatgtcagaggacgctgcgaatgaccaagtccgcgtagcgacgcctgccattgcaagagagaaaggttcatcagcgattgtagtaggacgctcgattacaaaagcggaagacccggtaaaagcctataaggctgtcagacttgaatgggagggaatcaaatcttgaaacaaatcatcgcaaaacatctattagacatccaagctgtatttttacgcccgaacgagccgttcacatgggcaagcggcattttatcaccgatctactgtgacaaccgccttacgctatctttcccagaggtcagaaacgatgttgcttcaggtatcagcaagcttgtcaaagagcattttcctgaagctgaaatgattgcgggaacagcaactgctggtattcctcatgctgctcttgcggctgaccgtttgaatcttccgatgtgttatgtgaggagcaagccgaaggcgcacggaaaaggcaatcagattgagggagctgtgcaagaagggcaaaaaacagttgtcattgaagacttaatttccacaggaggcagtgtgcttgaagcttgtgcagctttacaagcggccggctgtgaagtgcttggtgtcgtctcaatctttacgtacggacttcctaaagcggaggaagccttcgcaaaggcagaactgccatactactcattaactgattatgatacgctcacagaggtcgcgcttgaaaacggaaatattcattcagatgatctaaaaaagctgcaaacatggaaacaaaatcccgagtcaaaagattggtttaaaaaataaaaaataaattcaaatgatgtaaagaggcttcaaagccttgatgtacttgaaaacaggctgtgaggcctgtttttttattaatcctataaaaaaagtcgggttgacttatgttagaattgtgctaaaatttactacaaatctaaaaacttatcaagagcggctgagggactggacctatgaagcccggcaacctgcatagtttgtaaggtgctacttccagcaaaatgaattccattttgaaagataagggctacatgctgttcctgtctttctttccgccggattgaaagttttttattttaagaggtaaaaaggctatctgtatatcagcagccgcgaatcacattacatgggaaaagacaaccggcagaaagctactgtttgtttgtctccgaaaggaggaaagaagaaatgttaacgtatgataattgggaagaaccaacgattacatttccggaagacgatccttataaaggagcgctgtcagttttaaaatgggcatacggccattacggcgatcagcttgtttatgcctgcagtttcggaattgagggaatcgttctgattgacttaatttataaagtgaaaaaagacgcagagattgtgtttcttgatacaggacttcattttaaagaaacctatgaaacaattgaacgagtgaaagagcgttatccgggtcttaatatcatcctgaaaaaaccagacctcacccttgaggaacaagccgaagaacatggtgacaaactatgggaaagagagccgaatcagtgctgctatcttagaaaggtcgttcctttaagagaggcgctttcaggacatccagcctggctttccggcctgcgccgtgatcaagggccaagccgtgccaatacgaatttcttaaacaaagatgaaaaattcaagtcagtaaaagtttgcccgcttatccattggacttggaaagacatttggagatacacatcccggaatgaactggactacaatccgcttcatgaccaaggatatccaagtattggatgtgcgccttgcactgctcccgcttttacagcagaggatttgcgctcaggcagatggaatggtatggcgaaaacagaatgcggactgcatgaataaggagctgcaaaatggaattagccgctattttatttagcttgtttttcgcgatgaatattggtgcaagcggcgctgcagcttcgatgggggttgcttacggctccggagccatcaaaaagaaaacctacgctttgatcctatgcgcagtcggtgtctttaccggggcggtcattggcggaggcgaggttgtaaaaacaatcagctccggcattattcctgagcagacgattacactgacgattgtttgcatcattattggagctgctgccctgtcgctctttactgctaacctgctcggtattcctttgtcgacaagtgaagtaacagtcggcgcggttgtcggcgtgggagtggcttataaagtattgtttgtgaacaatcttctgatcattgtgtcattttgggtttttgtcccgctgttcgctttcggcttcacctatttcgtatctaagctgtttcgttattttaagattgaagtaaaatcttctaaaaagcaaaaaatcctcggcattgttttgttagttgccggatttttcgaagcattctctgccggcatgaataacgtggcgaatgctgttggcccgttagtagctgccgatgtgcttgatgtcggaaaaggaaccttgtatggaggagcttttgttgctcttggcgcactgttattaggccggcgagtgctagaaacaaacgggaagaaaattacgagattctccaaaggggaaggcattctcttatccggtacaggagcgggactggtgatcatcagttctgtatttgggatgccggtgcccttggcgcaagtcacgtcatcgtctattatcggaataggcatggcaaaaaacggtccgaacgtgttccataaacaagttgttcaaacgatgctgaaggtatggatcgtatcgccgtttttatctttatcgatttcttatctgcttgtatccttgtttttaaaagcagattattattcgatctttatcatggtaagtgtgcttttagcggcgggcggtgccgtcagcctgacaaaggccattcgtaaagagagacgctcagtccacgaacaaggcgggggaatctgatcattaatctgagtaaatttataagttaactaggaggagatggatattatgagcttagcaccacacggaggaacattagtaaacagagtagatgaatcatatgatgtgagcggcattcaaaaagaaattgaacttgatttaatttctttcgcggatttggaattgatcggtatcggtgcatacagcccgattgaaggtttctttaatgaaaaagattacgtatctgttgtcgaaaacatgcgtctttcttccggcgttgtctggtctcttccaatcacgcttccggtcgatgcgcaaaaagcagcggaactgtcagttggtgaaacggtaaaattagcgtatgaaggagaaacatacggcgttatccaaatcgaagacctgtacgtgcctgacaaacaaaaagaagctgtcaatgtgtacaaaacagatgaacaggagcatcctggtgttaaaaagctgttcagccgcggcaatacatatgtcggcgggccgattacgttgattaaaaaagcttcaaaacagttccctgaatttacatttgaaccgtcagaaacgagacgccagtttgcggaaaatggctgggaaaccattgtcggtttccaaacaagaaaccctgttcacagagcgcatgaatacattcaaaaaacggctcttgaaacagtagacggcttgttcttgaatccgttagtaggtgaaacaaaatctgatgacattccagctgatgtacggatggaaagctaccaagtgcttcttgatcattactacccgaaagatcgcgttttccttggtgtctttttagcggcgatgcgttatgcaggcccgagagaagcaattttccacgcgcttgtcagaaagaactacggctgcacacatttcatcgtcggccgtgatcatgcaggtgtaggtgactattacggaacatacgaagcacaggagctgtttgacacatttaaacctgaagaactcgggataacgccgctgaaattcgagcacagcttcttctgtaaaaaatgcggaaatatgggaaccgcgaaaacatgccctcatggcagagagcatcacgtcattttatcaggcactaaggtaagaggcatgctgagagacggtgtgctgccgcctgctgaattcagtcgaaaagaagtcgtagaagtgttaatcaaagggatgaagaaaaaagaagaagtaggcgtatcttaaggaggactgacagtgacaaatcgcgatattgtatggcatgaagcctctatcacaaaagaagagtatcagcaaaaaaataagcataaaagctccattctctggctgacagggttaagcggctcaggcaaatcaaccattgccaacgccgctgcaagagaattgtttgagcaaggctaccaagtgattgtgctggacggggataatatccgtcacggcttaaataaggatcttggtttttctgatgaagaccgaaaagaaaacatccgccgaatcggagaggtggcaaagctttttgttcagcagggaaccattgtgattactgcttttatctctcctttccgcgaggacagacaacaggttcgcgagcttgtggaagcgggcgaatttaatgaagtctacattaaatgcgaccttgatatttgtgaacaaagagatccgaaagggctttacaaaaaagcaagaaacggcgagattccgttttttacaggaattgattctccttatgaagaaccggaagctccagagctcgttcttgattcaggacaacatgaccgtgaagcgtgtaaaaatcagctgatcgagtttgttaaacaaaaattgagctgaatatgatctgctgcgttcttctcagatgccggaatgcaagcgagaacatcatcacagcgaatgctctggaagaactcgaatagatcgggggaaatacgatggggaaagtatatattgtaggagcgggtcctggtgaccctgatctgctgacaattaaagcgctgaaagccattgaaaaagctgatgtcatcttatatgacagattagtaaataaagagattttacaatatgccaaagagcaagcagacctgatctactgcgggaagcttccagattttcatacgatgaagcaggaaaccatcaatcgatttcttgtgaagtatgcgcaaaaagggaaaatggttgtcagactgaaaggcggagacccttttgtgttcggcagaggaggggaagaagcggaatgcctctctgaaaatggaattccgtttgaaatcatccccggcattacgtctggaatcgcggcagccgcttatgccgggattcctgttactcatcgggaggcgggctctaacgtcgcttttgtaacgggtcattataaaaaagaagaagattttgaggaaaagtggaaagcgctggctacaggaattgatacacttgtcatctatatgggtatcaaaaacgtgcagcagatagaaagaaaactccttgaaaacggccgggacggttctacgccggcagcctttattcattggggaacaacggacaagcaaaaatctgttttttgtacagttgacaccctttcagaaacggtgataaaagaaaacattacaaatccgagtttaattgtcattggaaatgttgtaaattatcactataagctggaatggtttgaatctgaactgaaaaaacaagatttaagcgaggcgttgtaataatgaaacaagcaattttatatgtcggccacggcagccgggtcaaaaaagcgcagcaagaagccgcagcctttttggaaggatgcaaggcccacatctctgtgccagtacaagaaatcagctttttagagcttcaggagccgacaattgagacaggatttgaagcatgtgtgaagcaaggcgccactcatatcgcagtggtgcctctgcttcttttaacagctgcgcatgcaaaacatgatattccggaagaaattgcgcgtgttgcatctcgatatccgtcaatccgcatttcatacggaaagccgatcgggattgacgaagaagtagtcaaggctgtatatcaccgaatgaaagacataggtgttccatatgaaaatgccagagtggtactcatcggaaggggaagttcagatccagatgtcaaaagagacgtaaccggtattgctaatcttcttcaggaaatgattccagtcaaggaagtcattccgtgctttttgacagcatgcggccctaattacaaagaggttttttcagaacttaaaaaagatgacggcataacaacctttatcgttccatatttgctctttacgggaatgctgatgaatgaaatcgaacgagaggttcagaaattaaaagctcataatccgaacgtctacctctcttcctatatcggttttcatcctcatgtgaaaaacgcatttttgaaccgtgtgagagaaactgcggcaaatcctgaggggcaatttgattttgatggaggttcatatgcttccgctgcacattagcctggaaaagaagaaggttgtgattgcggggggcggcagcatcgctctcagaaggctgaaaacggtgatttctgagggagctgatataacgctcgtcagtccggatgttgaaccggaaatcaagcaaatggcagaagagcgacgtatcaaatgggaaaaacggacaattgaaaaagaagattatctcaatgctttcttaattattgctgcgacggataatgcggcagtgaacaaagaaattgcccaatccgcttcgccttttcagcttgtcaattgtgtcagtgacgctgagcttggcaatgtatatatgccgaaaatcgtcaaaagagggcatgtcactgtgtctgtttctacaagcggagccagtccaaagcacacgaaagagcttgctgaaaacgtggataagctgattgacggcgattttgttgctgaagtgaacaggctttatcaggtgagaagaaagaaataagccagagcatacaaatgctctggcttttctttatgcggctcagctttttttgagcttgatgacagtatcagcatcaggcgtgacaaagacggtatgctggctgtcataggtgacgaaaccgggtttcgcgccgtttggttttttgacatgcctgatttttgtataatctacaggcactgaacttgaatctttagcttttgaaaaataagctgcaattgtcgcggcttccatgattgtttgctcatccggttcgctgcttctgatcacaacgtgggagcctggaatgtccttcgtgtgaagccagatatcgtctctggccgccactcttgtcgttaaatattcattttgacgattgttcttacccactaaaattgtcagccctgaggtggattcatatgtttctaacaccggattgtgcggtttttgctttttctggcctttttgctgcttagggcgtaaatatttgccctctacgagctcttccctgatttcgctgatatcccggggagaagcggacgaaagctgctgaatcagctgatcaaaatattcgatctcttcctgtgccagcctgatttgctcctcgacaactgcgaccgaatttttcgctttctgatacttcgtgaaataggcctgtgcgttttcagaaggcgttttgttcgggtttaaaggaatcgtgattgtcgggctttcttcatcataataattgatgacctcagcctgtttatcaccttttttcagcatatataaattagcggttaaaagctccccgtaaagctgaaattccttcgcgttttccgaatactccaaggttttctctaattttttaattttgttggcattcttcttccgttcgttcacaacaaaacgctcaagatcctgagcctgctgtttgacccggtctcgttcagcttttccgaaataaaaacggtcgagcagttcgcttaatgaatcaaaacggcgcgcttcgccctttagatgagtcagctccagcagataaaaatattcctttccgtttacagtcgtaatgttgggaatgaaacggtgctctttcacttcggcaaacagtgccagcaacgcttttggcagtgtgactttgttagcaaggcctgctctgtgaactgcttctttggcgaaaagcggagacacgcctgaaaagtggtcgacaatttgtttatcaagccttccttcttgaaagctgaggtgacgcaaaatatcatcttctgacacctcaagaggcgatattttgtcctgagcaggcggaagcttataatcttggccgggcagtactgtacggtagctgttcattgacggtgataaatgcttaagtccgtcgataatcacattttctgctgcgtcagtcaaaatgatattgctgtggcggcccataatttctacataaagctttcgtacggtttcatcgccaatttcgtttcggcttttgatatgaaaaatcatgatgcggtctaagcccgcttgttcaattttctcaatgaatccgccttcgatatgctttctcagcaacatgcaaaacattggcggttcgcttggattttcataagcttgtgccgtgatatgcacccgtgaatagctcggatgtgccgataataatagtttttggttttttcccttggcacggatgtggaaaatcacatcgtgcttatatggctgatggacttttgtaattcgtccgcccattattttttcattaagttcgtgtgtcattccgtatgtaaacatgccatcaaacgacatatgcaatacaccctctcattcttcctgcattcgataattatagcatgaaatgggacgagtcagaataagcatgcttatagagtgatatctctataagagagcaggggagtggacgagcggaatgaagtttcatgaaatgggacaaacagatttactagaggcaaccaatacgtccatgaaacaaggattaactgaaaaagaggtaaaaaaacgtcttgacaagcatggaccaaacgagctgcaagaagggaaaaaaacttcagcgcttctcttgtttttcgcgcagttcaaagattttatggtgcttgttcttctggcggcaacgttaatctcaggttttcttggtgaatatgtagatgcggttgcgattattgcgattgtgtttgtgaatggcatactcggtttctttcaagaaaggcgtgctgagcaatctcttcaggctttaaaagagctttcaacaccgcatgtcatggcactcagggaaggaagctggacaaagattccttctaaggaacttgtgccgggggatattgtgaaatttacgagcggggacagaattggcgcagacgttcgaattgttgaagcgagaagccttgaaatagaagaatcagcgctgaccggggaatcaatcccggttgtgaagcatgctgataaattgaaaaaaccggatgtttcacttggcgatattaccaatatggcatttatgggaacgattgtgacccgcggcagcggtgtcggggttgtcgtcgggacaggaatgaatacggctatggggaaaattgccgacatgcttgaatcggcagggacattgtcaaccccgctgcaaagaagactggagcagctcgggaagattttgattgttgttgcattgcttctgaccgtacttgtcgttgctgtcggtgttattcagggtcatgatctgtacagtatgtttttagcaggtgtctcgttagcggtagccgctattccggaggggctgccggcgattgtgacagtggcgctttcgcttggtgtacagcggatgattaaacaaaaatccattgttagaaagcttcctgctgttgaaacgcttgggtgtgcgtctatcatttgttcagataaaacagggacaatgacccaaaacaaaatgacggtgacacatgtctggtccggagggaaaacatggagagtggcaggggccggctatgaaccgaaaggaagcttcacactaaacgaaaaagagatcagtgtcaatgaacataagccgcttcagcagatgcttctgttcggagcgctttgtaacaactccaatattgagaaaagagacggcgaatatgtgcttgacggagatccgacagagggagcgctgctcaccgcggcaagaaaaggcggtttttcaaaggagtttgttgaatcaaactaccgggtgatcgaagaatttccgtttgattctgcacggaaaatgatgactgtcatcgtagaggatcaagacagaaagcgttatatcattacaaaaggtgcaccggatgtactgatgcagcgatcttcccgtatttattatgacggctcagcggctcttttttcaaatgaaagaaaagcagaaacagaggcggtattaagacatttggcatcacaggcgctcagaacgatagcggtcgcctacaggccaataaaagcaggcgaaacaccgtcaatggaacaggcggaaaaagatctgaccatgcttggcctttcaggtatcattgatccccgcggccggaagtcagacaggcgataaaagaatgccgtgaagcaggaattaagaccgttatgataacaggtgatcatgtagaaaccgctaaagcgatagcgaaagacttgcgcctccttccgaaaagcggcaaaatcatggacggcaagatgctgaatgaactttctcaagaagagctttctcatgtggtggaggatgtatatgtatttgcccgcgtttcccctgaacataaactaaaaatcgtaaaagcctatcaggagaacgggcatattgtggcgatgacgggagacggcgtcaatgatgctcctgccattaaacaagctgatatcggcgtctctatgggtattaccgggacagatgtggccaaagaagcatcatctcttgttctcgtagatgataattttgcgacgattaaatcagcgataaaagaaggcaggaacatctacgaaaatatcaggaagtttatcagatacctgttggcgtctaacgtcggagaaatccttgtcatgctgtttgcgatgctgctggcccttcctttaccgctcgttccgattcagattttgtgggtcaacttggtgacggacggattgccggcaatggcgctcggcatggatcagccggaaggagacgtcatgaagcgcaagccccgtcatccgaaagaaggggtatttgcccgcaagctaggatggaaggtcgtttccagaggatttttaatcggagttgccactattttagcgtttatcattgtgtaccaccgcaatccggaaaacttggcttatgcccagacgatcgcgtttgccacattggtgctcgctcagcttattcacgtgtttgactgccgcagcgaaacttctgttttctctagaaatccgtttcaaaacctgtatttaatcggcgcggtattgtcatccattttgctgatgcttgtagtaatctactatccgccgcttcagccgattttccatactgtagccatcacgccggggactggatgctcgtcatcggtatgtccgccatccctacttttttgctggcggggtcacttttaacaagaaaaaaataaattcatatgatataatcttaggggtaatagcgtgtctattgcccttttattatgagaacagggaagaattgggtgttttaaaatgatacgaagtatgacaggcttcggcagtgcaagcaaaacacaagacgatctctctgtaagcgttgaacttaaatctgtgaactacagatttaaagaagtgaacgctcgtttgccaaggcctttgctatattttgaagataagctgaaacagaccattctgcagcatattcagcgcggaagaattgagcttttcgtatccgttgacagcgatatgcttgttgagaaaaggcttgaaattgattggccgctgctcgatgagtttgtcgcagccgcgagagatatgaagaagcggtatcaattgtctgcagagcccgatgtaatggatttctttaagcttgatcatgtcgtccaggttcatgaagaacagacgcaaaatgacaagctggaggcgttgatcatcgatgctgcagaagaagcggtaaaaggtctctgtgaaatgcgtgaaaaagaggggctgctcttagcgaaagactgcctgatgcatattgatcagcttgaagagctggtgagagaaactgaattgctggctgcagatgtcgtatctcgttatcgggaacggctgtacgccagaatcaaagaatggactgaagacgtattagacgagagccggcttgtaacagaatgcgctatttttgcagaccgctctgatatcactgaagagattacaagactgaagagccacttcgcccagtttcgtgatatattagctagtggcggagctgtcgggcgcaaactcgactttcttgttcaggagctcaatcgggaagcaaatacgattggctcaaaagcaaatgatcatcagatcacaaagcttgtcgttgaaatgaaaagttctattgaaaaaataaaagaacaagtgcaaaatatagaatagtgactgtgcgtattgtttacagacggtcttactaggctaaactagagacgtctattttacagggggaacgtagaagatgacgattaaactgattaatatcggatttggcaatatcatctccgccaatcggatgatttcgattgtcagcccggagtctgcgccaatcaaacggatgattcaggatgcaagagaccgcggaatgctaattgacgctacatacggacgaagaacccgtgcagttgtcgtcatggatagtgatcacattatcttatctgccgtccagcctgagacagttgcacacagactttctgttaaagaagaaattatggatgaagggcaggggtaattgccgcatgaaagaaagagggttattaatcgttctctcaggtccctcaggagttggtaaaggaacggttcgacaagcaatcttttcgcaggaagacacaaaatttgaatattcgatttcagtaaccacaagaagtccaagagagggcgaagtgaacggagtcgattattttttcaaaacaagagacgaattcgaacaaatgattgcggacaacaagctgcttgaatgggcagagtatgtcggcaattattacggcacgccagtcgattatgttgaacagacgcttcaagatggaaaagacgtctttttagaaattgaagttcaaggggctcttcaagtgagaaatgctttcccggaaggcctgtttattttccttgcgcctccaagcctttctgaactgaaaaacagaatcgtgacacgaggcacagaaacagacgctctgattgaaaatcgaatgaaagccgcaaaagctgagatcgaaatgatggatgcttatgactatgtcgttgaaaacgataatgtcgaaacggcttgcgataaaatcaaagcaatcgttcttgctgaacatttgaagcgtgaacgcgttgcaccaagatataagaaaatgctggaggttgaataatcaatgttagatccgtcaattgattctttaatgaataaattagattcaaaatatacgctggtgactgtttctgcgagacgcgcacgtgaaatgcaaatcaaaaaagaccaaatgattgaacatacgatttcacacaaatatgtaggcaaagctttagaagaaattgatgcaggcctgctttcgtttgaaaaggaagaccgcgaatagtagcacaagtagcaacctatatcatgtaggttgttatttttttccgtgcggttttgtaaagtgcagagggggagaattcattgctaaacaatcgaaatgtgttactttgcgtgagcggaggcatcgctgtttataaagcctgtgcgttaacgagcaagctggttcaggcaggagcaaatgtcaaagtgattatgactgaatccgcttgccgattcgtttcaccgctgacatttcaggcattgagccgccacgaagtctatacagatacatttaaagaacaaaatccaagcgttatttctcatattgatgccgcagactgggccgacttgattatcgtagcgccggctacagctaatgtgattggaaaactggcaaacggcatcgctgatgatatgctgacgacaacattgttggcagcaacggctcccgtttggatcgcgccggcaatgaacgttcacatgtatgaccacccggcagtcaaacgaaatatttctgttctttatcaggacggttatcgttttattgagccaagtgagggctatttagcatgcggttatgtaggaaaaggcagattggaagagccggaaaacatcgtaaagctggccgaaaaacattttgctgaagaaacatccgctcctttagaaggcaagcatgtggtcgttacagccggcccaacgcgggaagcggttgatcctgtccggttttttaccaataaatcgacgggcaaaatgggctacgcattagcggaggctgctgttcagctcggcgcacgggtaaccttaatttctgggcctgtttcacttgatcagcctaaaggccttgctgagtttatccctgttcaatcggctgcggatatgcgcgaagctgtgctctctgtgtatgacgcaagcgatatagtcattaaaacagctgcggtagccgattttacgccgaaaacagtatttgaccataaaatgaaaaaacaagacggcggcatgaccttagaactgaaaagaacagtcgacattttgaaagaattgggcgagaaaaagaaagagcagattttggtcggatttgccgccgaaacacaagacattgaacactatgcacgtaaaaagctcgccgctaaaaaccttgatttgattgtggcaaatgatgtgaaagcaaatggggccggttttggtgctgatacgaatatcgtgacaatctttttcaaagacgggcataaacgcgaactcccgatcatgtctaagctcgatgtttcttttgaaatccttcaggagatcgcagccctctcaaaacaaaccggagagcgctcatgaattttgcagaagtcatcgttgatgtcagcaccaaaaatatagacaggccttttgattataaaatcccagaccatctcaagggcatgatcaaaacggggatgcgggtcattgttccatttggcccccgtaagattcaagggtttgtgacagcagtcaaagaaacatctgacctatcggggaaatctgtcaaggaagtagaggatttattagatcttacacctgttctgacagaagagcttatggatctgtcatcatggctgtcagacaaaacgctgtcttttaaaataacggcgcttcaagcaatgctgcctgccgccttaaaggcgaaatatgaaaaagaattaaaaattgcacacggcgccgatcttccgccgcaagtggaacggctgttttctgaaacaaagacgctgctgtattcagatatacccgatcatgatacgctgaaactgattcaaaggcatgttcaaaaaggggacattgacgtgacgtataaagtcgcgcaaaaaaccaataaaaaaatggtcaggcatattcaggcaaatgcgagtaaagaagagcttgctaagcaggctgagggattgtctcgccaagcagcaaaacagcaggcgattcttcactttctcatctctgagccggaaggtgtgaaaattcctgcggcgcaattgtgcaaaaaaacggacacgagctctgcaaccatcaaaacccttatccaaaaagggcttttgaaggaaagctatgaagaggtttatagagatccctatcaggacaaaatgttcaaaaaaacagagcccctgccgctgacagacgaacagagggctgccttcgagcccatacgcgagacattggacagcgatgagcataaagtgttcctccttcacggcgtgacaggaagcggaaaaacggaaatttatctgcaatcaattgaaaaagtactggcgaaaggaaaagaagccatcgtcctcgtacccgaaatatcgctgacgccgcaaatggtcaaccgcttcaagggccgcttcggctcccaggtggcagtcatgcacagtggtttatccacaggagaaaaatatgacgagtggcgtaaaatccaccggaaggaagtacggcttgtcgtcggtgccagatccgccatttttgctccgtttgaaaatctcggaatgataatcatcgatgaagaacacgagtcttcctataaacaggaagaaatgccgcgctatcatgcgaaagaggtggcaatcaagcgggctgagcatcacagctgcccggttgtattagggagtgctacgccgacattagaatcatatgcaagagcgcaaaagggcgtatacgagcttctttcactgaagcaccgtgttaaccatcgggtgatgcccgaggtttcgcttgtcgatatgagagaggagcttagaaacggcaatcgctcgatgttttcggttgaattgatggaaaagcttgaagaaacgattgcaaagggtgagcaggcggtgctgtttttaaataagaggggctattcttcctttgtgatgtgcagggattgcggctatgtcccgcaatgcccgcactgcgacatttccatgacgtatcatcgttacggccaaaggctgaaatgccattattgcggacatgaagagcctgttccgcacacttgtcctgaatgcgcaagcgagcatatccgctttttcggaacgggaacacagcgagtggaggaagagctgacaaaagtgctgccaagtgcgagagtgattcggatggatgttgacacgacatcacggaaaggcgcccatgaaaaattactgtcagctttcggagaaggaaaagcggatattcttctcggaacgcaaatgatcgcgaaagggcttgattttccgaatgtcacgcttgtcggagtgttaagtgctgatacaacacttcatattcctgatttcagatcggctgaaaaaacatttcagctgttaacgcaagtcagcggccgggcaggcaggcatgaaaagcccggccatgtcatcattcaaacgtatacaccgtctcattacagtatccagctgacgaaaacacacgattatgaaacgttctatcagcatgaaatggcgcacaggagagagcaatcctatccgccatactactatttggctcttgtgactgtttctcatgaggaagtggcgaaagcagcggttacagctgaaaaaatcgctcattttttgaaagcaaactgcggagctgacacgaaaattctcggaccaagcgcgtcgccgatagccaggatcaaagatagatatcgctatcaatgcgtgataaaatacaaacaggaaacccagttatctgctttattgaagaagatactggaacattataaacgcgaaattgaacaaaaacatgtaatgatttcaattgatatgaatccttatatgatgatgtaagatctcacgtcttggagggtaacaaattggcagtaaaaaaggtcgtcacacatcctgcggaggttttggaaacacctgcggaaaccgtgactgtttttgataaaaagctaaaaaaactgcttgatgatatgtacgacaccatgcttgaaatggatggtgtcggactggcagcgccgcaaatcggcattttaaaaagagcggccgttgtagatatcggggatgacagagggagaattgatctcgttaatcctgaaattttagaaagaagcggcgagcaaaccggaattgaaggatgcttgagctttcctggcgtctatggtgatgtcaaacgtgccgattatgtcaaagtgcgtgcgtttaaccgtcagggaaaaccgttcattctggaagcgcgaggctttttagcaagagccgtgcagcatgaaatggaccacttagacggtgtgctgtttacatctaaaataagtaaatactatacagaagatgaactagcggatatggaaggatgatttgatgacgagaatcgtatttatgggaacgccggatttttcagttcctgttttaagaaccctgattgaggacggatatgaagtagtgggggtcgtcacacagccggaccgtccgaagggcagaaaaaaagtcatgacacctcctccggtcaaggaagaggcattgcgtcacggcatcccggttcttcagccggaaaaagtcagattgacagaagaaattgagaaagtgctggcattaaagcctgacctgattgtaacggcggcattcggacaaattttgcctaaagagcttctcgacagtccaaagtacggctgcattaacgttcacgcatcccttttgccggaactgcgcggcggtgctccgattcattattccattctgcagggaaagaagaaaaccggggttaccattatgtatatggtagaaaaattggatgcgggcgatatgatctcaaaagtggaagtggacattgaagaaaccgacaatgtcggaacactgcacgataaattaagcgcggctggcgcgaagctattgtctgaaacggttccaaacgttattgccggcagcatttcacctgaaaagcaggatgaagagaaagcgacatacgcgcctaatatcaaaagagagcaagagctgctcgactggtccagaacgggcgaagagctttacaaccagatccgcggcttaaatccatggcctgttgcttatacgactctaaacggacaaaacttgaaaatatgggcgtcgaaaaaaatagcggcaccaacaacagctgagcccggcacagtcgttgcagttgaaaaggaaggaattatcgttgccacaggtaatgatacggccctgttattaaccgaacttcagccggccggcaaaaaacgaatgaaaggcgaggactttgtgcgaggcgctcatgttgaagccggtgatgtgttaggagtaaacaatgaaaaaaactagtgttcgtgacatcgcccttgaggcgctgatcaaattagaacaaaaccaggcatatagcaacctgctgctgaaatcggtcattaaatcaaatgaactgagtgatcaggacagagggcttttgactgaacttgtctatggtacattacaaaataagatcgcgcttgattatatgcttaaaccgtttatcaataagcctcaaaaggtaaaggcgtgggtgattcagctacttcgcctatccttatatcaaatggagtatttagagaagattccagacagggcagccatccatgaagcggttgagattgctaaaatccgcggacacaaaggcattgcttcatttgtcaacggcgtgctccgttctattcagcgcgaaggtgttccatcctttgacgcgatcgaagatcctgtacgccggctggcgacagaaacaagccatccggaatggcttgtgaaagagtgggcggatgcgtatggatttgaagctgcggaaaagatttgccgcatccatctcattccgccgaagcagacgctgcgtgtcaatgaaatgaaagcagacagagctgagctgcttgaccaaatggctgctgagggaatcgaagttgaaaaaggcgacctcgctgaagatgctgtgaagctcttaaagggaacaattgccggaactcatttcttccaaaacggcgaagtttccatccaggatgagagctccatgctcgtcgcccgcgcccttgaccctaagcctgatgaaacagtgcttgacgcgtgtgcggcgcctggcggaaagtcggctcatatcgcagaattaatgaagaacaaggggagcgttacgtcgcttgatcttcacaaacataaagtgaagctaatcaaagaagcggcagatcggcttggcctgacaatcattcatgcggaaacaatggatgcaagaaaagcaggggaaacgtttgaaaacgaacagtttgaccgaatattggtcgatgccccgtgctcaggtttcggtgttatcagaagaaagccggacatgaaatacacgaaaaagcctgacgacagcgcccgtctagctgaaatccagctgtcgatcttgagggaaatcgcaccattagtaaaaaaaggtggcactcttgtctacagtacgtgtacaatggaccggacagaaaatgatgaagtaatacatgcgtttatacaagaacatcctgattttgaacccgatttgtctcttgaaaagcggctgcctgaaaaggtgagaccctttgttcgggatggaaggcttcaaatccttcctcattatttcggaacagatggtttctttatttgcagcatgagaaagaagggataagcaatggcagaacttaataaaacaaaagtaagaaaagaattgcggacagagcgtccgtctatttattcttttgaattagatgaaattaaacaatggctgacagacaacggagagaaaccgttccgtgcggctcagatctttgaatggctatatgaaaaacgcgtatcttcttttgaagaaatgacaaacctctcaaaggatctgcgtgagaaattaaacactcactttgtgttaacaacgctgaaaacggctgttaaacaaacttctcaagacggtacgatgaagtttttgtttgagcttcatgacggttataccatcgaaaccgttttaatgagacacgagtatggcaattctgtatgtgtaacgacacaagtcggctgccgtattggctgcacattctgcgcgtcaacgcttggaggcttaaaacgaaaccttgaagcaggggaaattgtcgctcaagtagtcaaagtgcaaaaagctcttgatgaaacggatgaacgcgtcagctctgtcgtgatcatgggaatcggcgaaccttttgataactttaacgaaatgctcgctttcttgaaaatcattaaccatgacaagggcctgaatatcggtgctcgccatattacggtctctacgagtggaatcatcccgaaaatttacgaatttgctgatcagcaaatgcagattaactttgcaatttctctgcacgcgccgaacacagaaatcagaagccgtttgatgccgattaacagagcatataaactgcctgatctaatggaagccgttaaatattatattaataaaacgggacgccgcatcagctttgaatacgggctgttcggaggtgtaaacgaccaggtggaacacgccgaagagcttgccgacttgctggaaggagtcaaatgccacgtgaacttgattccggtaaactacgtgcctgaacgggactatgtgcgcacaccgcgtgatcagatttttgcttttgaaaaaacgctgaaatcccgcggagtaaatgtcacaatccgaagagagcaaggacatgacattgacgcagcctgcggtcagcttcgcgcgaaggagcgtcaagacgagacgaggtgatgagggttgttaacagccttaaaaacagatacaggaaaaatccgccagcataatgaagatgatgcggggatattcaaggggaaagatgaatttatattagcggttgtcgctgatggcatgggcggccatcttgctggagatgttgcgagcaagatggctgtgaaagccatgggggagaaatggaatgaagcagagacgattccaactgcgccctcggaatgtgaaaaatggctcattgaacagattctttcggtaaacagcaaaatatacgatcacgctcaagcccacgaagaatgccaaggcatggggacgacgattgtatgtgcgctttttacggggaaaacggtttctgttgcccatatcggagacagcagatgctatttgcttcaggacgatgatttcgttcaagtgacagaagaccattcgcttgtaaatgaactggttcgcactggagagatttccagagaagacgctgaacatcatccgcgaaaaaatgtgttgacgaaggcgcttggaacagaccagtcagtcagcattgacacccgttcctttgatatagaacccggagacaaactgcttctatgttctgacggactgacgaataaagtggaaggcactgagttaaaagacatcctgcaaagcgattcagctcctcaggaaaaagtaaacctgcttgtggacaaagccaatcagaatggcggagaagacaacataacagcagttttgcttgagcttgctttacaagttgaagagggtgaagatcagtgctaatcggcaagcggatcagcgggcgttaccaaattctccgcgttataggtggcgggggaatggccaacgtgtatttagctgaggatatcattctagaccgtgaagtcgcaattaaaatcctgcggtttgactatgcaaatgacaatgaatttatcagacgtttccgcagagaagcccaatccgcatcaagcctcgatcacccgaatattgtcagcatttacgatttgggcgaggaagatgatatttattatattgtcatggaatacgttgaaggcatgacgcttaaagaatacataacagcaaatgggccgcttcaccctaaagaagcgctgaacatcatggagcaaatagtctcagccatcgctcatgcccatcaaaaccagattgttcacagagacatcaagccgcataacattttgattgatcatatgggaaatatcaaagtaacggattttggaattgcgacggcactaagttcgaccacaatcacccataccaattcagttctgggctcggtccattacttatcacctgaacaggcccggggcggcttagccacaaaaaaatcggatatttatgcgcttggaatcgttctatttgagcttttaaccggccgtattccgtttgatggagagtcagcagtcagcatcgccttgaagcatcttcaagcggaaactccttcggcaaaaaggtggaatccatcggtcccccaaagcgttgaaaacatcatactcaaggcaactgccaaagatccttttcatcgctacgaaacggctgaagacatggaagcagacataaaaacagcttttgatgccgacagactcaatgaaaagagatttacgattcaagaagatgaagaaatgacaaaagcgatacctatcattaaagatgaagaactcgctaaagctgctggcgaaaaagaagctgaagtgacaaccgcacaagaaaacaaaacaaagaagaacggcaaaagaaaaaagtggccgtgggttttgctcacgatatgcctcgtttttatcacagctggaattcttgctgtcactgtttttccgtcgcttttcatgcctaaggatgtcaaaatacctgatgtctccggaatggaatacgaaaaagccgcagggctcttggaaaaagaaggtttacaggttgattccgagttgttggaaatctcagatgaaaaaattgaagagggcctgatggtaaaaacggatcctaaagcggataccacagtcaaagaaggcgccacggtcaccctttataagagcaccggaaaagcaaaaacggagatcggtgatgtgacaggccaaacggtcgaccaggcaaaaaaagcgttgaaggaccaagggtttaaacatgtaacagtaaatgaagtgaatgacgagaaaaatgcgggcactgtcattgaccaaaatccttcagcagggactgagcttgtcccgagtgaagatcaagtcaaacttacagtcagtatcggacccgaagacattacgcttagagacttgaaaacctacagtaaagaagcagcgtctggatatctggaggacaacggattgaagcttgtagaaaaagaagcatactcagatgatgttccagaaggacaggttgtcaaacaaaaaccagcagcaggtacggcagtaaagcccggaaacgaagttgaagtgacattctctctcggaccagagaaaaaacctgcgaaaacagtgaaagaaaaggtcaagatcccctacgaaccagaaaatgaaggggacgagcttcaagtgcaaatcgcggttgacgatgcggatcacagcatctctgacacttacgaagaatttaagataaaagagccgactgaacgaacgatcgaactaaagattgaacccggccaaaaagggtactatcaagtaatggtaaacaataaagttgtcagctacaaaaccattgagtatccgaaagatgaataacaaggagggaaaatatgcctgagggcaaaattattaaggcgctaagcggcttttactatgtactggatgaatcagaggattcagataaagtaatacaatgcagaggaagaggcattttcagaaaaaacaaaattacccctcttgtcggtgattatgttgtgtatcaagctgaaaatgacaaagaaggatatttaatggaaattaaagaaagaaccaacgagcttatcaggccgccaatttgcaacgttgatcaagcggtccttgttttctcagcggttcagccttctttcagcacggcattgctcgaccgcttcctggttctcgttgaggccaatgatattcagccgattatatgcattactaaaatggatctgattgaagatcaagatacagaagatacgatacaagcctatgcagaagactatcggaatattggttatgacgtataccttacctcctctaaggaccaagacagtttaacggacatcatcccgcattttcaggataaaacaacggtatttgccggtcagtccggtgttgggaaatcctcgcttctcaacgcgatcagtccggagctcggattgagaaccaacgagatttccgagcatttgggccgcgggaaacacacaacccgccacgtggagctgattcacacgtccggaggtttggttgcagatacgccgggattcagctcgcttgaatttacagacattgaggaagaagagctgggctataccttccctgatatcagagaaaaaagcgcttcatgcaaatttagaggctgtttacatctgaaagagccgaaatgcgcggtgaaacaagctgttgaagacggggaattaaagcagtatcgctatgaccattatgttgaatttatgacggagattaaagacagaaagccgaggtattagcataatgataaaggttgcaccatctattctttccgctgattttgccgctttaggcaatgagattaaagatgtagaaagaggcggagccgattgtattcatattgatgttatggacggccattttgtcccgaatatcacaatcggtccgctgattgtagaagcggtccgaccggtaacggatctgccgcttgatgtccatttaatgatagaagagccggatcgttatatcccggcttttgcgaaagcaggcgcagatatcctgtctgtgcatgctgaggcatgtccgcacctgcaccgtaccatccagctcattaaagagcaaggagtgaaggccggagtagttctaaacccgcatacccctgtacaagtcatcgagcatgttttcgacgatctcgatcttgttcttttaatgacggtgaacccgggcttcggcgggcagaaatttattcattcagtccttcctaagataaaagaggttaagcgaatggcggatgaaaaaggaaaaaaagatctgttaattgaagtagacggcggcgtcaacaaagaaaccgctccgctcgtcattgaagcgggcgcaaatttactcgttgccggttcagctgtttatgggcagtctgaccgcaaaaaagcaatttctgaaatcagaggaagcaaataagcagctttagaaaagagctgggcatacaatagcctaagctctttttcctgtatgcagagaaaggaatcagagatgaaaacaattaatatcgttgcgggaggcccgaaaaatctcattcccgatctaaccggctatacggatgcacacacgctttggatcggtgttgacaaaggcaacgtcactctcttagatgcagggatcatacctgttgaagccttcggagattttgacagcataaccgagcaagaacgccggcgaatagaaaaagccgctcccgcccttcatgtgtatcaagcagaaaaagatcaaacagatttagacctcgcccttgattgggcgctggaaaagcagccggatattattcagattttcggcattacaggcggcagagctgatcattttttaggaaacattcagcttctgtatagaggtgtaaaaacgaacataaaaattaggctgatagacaaacaaaatcatattcaaatgttccctcctggtgaatatgatattgagaaggatgaaaataagcgatatatctccttcataccgttttccgaagacatacatgagctgaccctgaccggttttaaatatcctctaaataattgtcatattacgctcggttcaacactatgtattagtaacgaactcattcattcacgaggtactttttcgtttgcaaaaggcatattaataatgataagaagcacggattaagcatgtgctttcattcaattgctgaaaacaatgaacaaggcggttacgggacgttataggaggggacaaaaatgaaattttacaccattaaattgccgaagtttttaggaggaattgtccgggcgatgctgggctcatttagaaaagattaaggcccaggggttcaaagccctctttcaccacataaaaacgcctgccacatatcggggcaggcgttcattttgttatacacgctcaactttaccggatttcaaagctcgagcagatacatatacttttttaggttttccgttcacaaggatacgaaccttttgaagattcgcgccccaagtgcgcttagaagcgttcattgcgtgagaacggttattcccagctgttgtttttttacctgtgataacgcatttacgtgccatttgtttccctcctcacttgcacaaaacatctactttttaacattcatataatcttagatgctttcgatatggatactttaaataatttaccacagctaaaaaacgtttgcaactattgtttcatcatctttcaagaaaattcacttgacatcttgcggaaacagcagcgctatagtatatgtagaggtacggccagcgattattgcctggtcttttcataatggaaaccatatagtagaatagctgtaactctatgcattcgaaggaggaactagtgtgtccattgaattaagaacgaagtacggacagattgatatatctaatgaagtcatcgcgatggttgcaggaggcgcggcggttgactgttacggcattgtcggcatggcctctaaaaaccagattaaagacggactgactgaaatccttcggaaagagaatttcagcaggggtgtccaagttcgccaagaaggagaacagatacatatcgacatgtatatcattgtcagctacggcacgaaaatttctgaagtggcacataatgtccaaacaaaagtaaagtacacagtaaatcaaaccatcggactggcagtggattctgtcaatatttatgtccaaggcgtacgagtgacgaacccgtagttaggaggagtaggattgtctatcagaacattagacggcagaacctttgccgagatgattcttgcgggagcgcagaatctgtctcaaaacgccagtgcagttgatgcactgaacgtgtttccggtgccggacggtgatacgggaacaaatatgaacctgtcgatgacttccggagcaagagaagttgaacaaatggatacggatgatatcgggaaggtgggctccgcgttatctaaagggctgctcatgggagcacgcggaaattcaggagttatcctatcccaattgttccgcggatttagcaaaaacattgaaacgaaaaaagaaattaatgcacttgagtttgccgctgcgctgcaagcaggtgtagacatggcgtataaagctgtcatgaaacctgtagagggcaccattttaacagttgcaaaagacgctgcaaaaaaagcaatgatcttagcagaaaaagaaaccgatatcactgcgctgatgactgcagtgacagaagaagcagaggcgtctttaaaccgcacccctgaattgctacctgtcctaaaggaagtaggagttgtcgatagcgggggcaaaggcctgctctgtgtgtatgaaggttttcttgcttcattaaaaggtgaaactgtacctcagaaagcagttcttccgtcacttgacgacatggtcagcgcagagcatcacaagagcgcgcaaagcatgatgaataccgaagatattgaatttggattctgtaccgaagtgatggttaggcttgatcagacaaaaagagagttcgacgaaggcacgttcaggcaagacctcagccagttcggagattctctgcttgtgattgcggatgaatcgctggcgaaggttcatattcatgctgaagagccgggaaacgtgttaaactacgcccagcattacggtgaattgatcaaaataaaaatagaaaatatgagagaacagcatacctctatcatcagtcaagaaagcaaacctgcagacaacgaaacaccgccggcaaaacagccgtatggcattgtgactgtagcgatgggagaaggaattgcagacctatttaaaagcattggcgcttctgttgtgattgaaggcggccagaccatgaacccaagcactgaggatattgttgatgccgtgaagtctgtaaatgcagatacggtatttatcctgcctaacaactccaacattatcatggctgctaaccaagcggccagcgtagtggatgaacaggtttttgtcattcctgctaaaacggttccgcaagggatgtcagccctgctggcttttaacccggatcaagcagctgaagcgaacgaggccaatatgctaagcgccattcagcaagtaaaaagcggacaggtgacgttctcagtcagagatactcatattgatggtaaagatattaaaaaaggcgactttatgggcattctgaatggaacgattatcggcacttctgaaaatcagctgtcagccgcgaaaatgctgctgtcagaaatgatcggagaagatgatgaaatcgtgaccattctatatggtgaggatgcgtctcaggaagaagctgagcagcttgaagcgtttctcagtgaaaagtacgaggagattgaggttgagatccacaatgggaaacagcctctgtattcgtatatagtttctgcagaatagaagggcaaattgcccttctattcttatgtctgcttttaagtgcggcagcgctgtaacgcgtccgcttgccattttatatctgatcaattagtctagaagcaaagcgctaataagctctggttcataaggaggaatagcatgaaatacagaagcgtttttgatattatcggcccggttatgatcggtccgtccagctctcatacagcgggagctgctagaatcgggagagtggccagaagtttatttggcagagagcctgagcgcatcattgtatctttttacggctcgtttgcggaaacgtataagggccacggcacagatgtcgcgattatcggcggattgcttgattttgatacattcgatgaacggattaaaaccgctatacaaattgcagaaactaaaggaattgatatagagtttcgggtagaagacgcagtcccggtccatccgaacacagcaaaaatcaccatttctgatgaaaagggtgagcttgaactgacgggtatttcgattggcggaggaaagattgaaatcacagaattgaatggttttgagctccggctgtcaggaaatcatccggccatattagttgttcataatgacaagtttggcacaattgccggtgttgccaatgttctggcgaaattttcaatcaacgtaggacatatggaagtagcccggaaagatatcggccagcttgcgctgatgacaatagaggtcgaccaaaatattgacgaccacattctcgacgagctgtcgaaactgccgaatattattcaagtgacaaagattgctgactagcgaaaagggtcaggaggagccagttatgtttcgtaatgtaaaagaattaattgagattactaaagaaaaacaaatattgatctctgatgtgatgatagctcaagagatggaagtaacagaaaaaacaaaagaggacatttttcagcagatggatcataacctgtctgttatggaagcggcggttcagaaaggactcgagggagttacgagccaaacgggcttaacaggcggagatgccgttaaattgcaggcctatattcgatcaggaaaaagcctgtctggcccgctgattttagatgctgtatcgaaagccgttgcaacaaatgaagtaaatgcagccatgggaaccatctgtgcgacaccgactgcaggttctgccggtgtggtgcccggtacgttatttgctgtaaaagaaaagctgaatccaacaagagaacaaatgatccgctttttgtttacagccggggctttcggatttgtcgtggctaataacgcaagcatttccggcgccgccggaggatgtcaggcagaggttggatcagcttcaggcatggcggctgcggccattgttgaaatggcaggaggaacacccgaacaaagcgcggaagccatggccattacattaaaaaatatgctaggcctcgtgtgcgaccctgttgcagggcttgttgaggtgccttgcgtgaaacggaatgcgatgggcgcgtcaaatgcgatgattgccgctgatatggcattggcgggcattacaagccgtattccatgtgatgaggtgatcgatgccatgtataaaataggccaaacgatgccaactgcacttagagaaacaggccagggcggtttagcggcaacaccgacaggaagagaattagagaaaaaaattttcggaggagcgctaggttcacgtgatacaacatcagcaaactagtatagctaacattaagggtattgggccggaaacagaaaaaacattgaatgaactcggtatttatgacatttctgatcttctgaattatttcccttatcgctatgatgactacgagctgagggatttagaagaagtaaagcatgatgaaagagtcacagtcgaagggaaggttcattcagagccttctcttacctattacggaaaaaaacgaaacaggctgacattcaggcttctggtcggccactatttaattacagccgtatgttttaaccggccttatttgaagaagcagctttcgctcggctctgtggtgacggtttcaggtaaatgggacaagcaccgccaaaccatctctgttcaggagttgaaaaacgggccgcatcaagaagacaaaagcattgaaccagtgtattctgtgaaagaaaatgttaccgtcaaaatgatgaggcgctttattcagcaggcgctgacccaatatgcagactcacttcctgatcctcttccggaaaagctaagaaaaagctataaactgcctgactattatcaagcgttaaaagcaatgcaccagcctgaaacaagggaagcattaaagcttgccagacggcggtttgtttatgaagaatttttgttgtttcagttgaaaatgcaggcgttccgaaaggcggaaagagagcagacacaagggatacggcagcgtttttcaaacgaagaactcatgagatttatcaaaagcctcccgtttcccctcacaaacgcccagtcacgcgttcttcgcgaaataacagcagacatgtcttctccatacagaatgaaccgtcttcttcaaggggacgttggatcaggaaaaacagcagtcgccgccattgcactgtatgccgcgatcctatccggataccaaggagcgctcatggtgccgacagaaattctggccgagcagcatgctgattcgctcgtttcgctatttgaaaaatgggacgtcagcgttgctcttttgacaagctctgttaaaggaaagcggcgaaaagaactgcttgagcgtcttgcggcgggtgagattgatattcttgtaggaacccacgctttaatccaagacgaggtggagtttaaggcgctgagtctcgttattacagatgaacagcacagatttggagttgagcagcgcaaaaagcttcggaacaaagggcaggatcccgatgttctctttatgacagccactccaatcccaagaacattagcgatcacagtgttcggtgaaatggatgtatctgtcattgatgagatgccggctggacgaaagcgaatcgaaacctattgggtaaaacatgacatgctggatcgtattttggcatttgtcgaaaaagaattaaagcaaggcaggcaggcttatatcatctgtccgctgattgaagaatcagacaagcttgatgtgcaaaacgccattgacgtgtacaatatgctttctgatatttttcggggaaaatggaaggtcggccttatgcatgggaagctgcattccgatgaaaaagaccaggtcatgagagaattcagcgcaaatcactgtcaaattctcgtatcaaccactgttgtggaggttggcgtgaatgttccgaatgcaacgattatggtgatttatgacgccgaccgtttcggactatcacagcttcaccagctgcgcggccgtgttggacggggtgagcatcaatctttctgtattctgatggctgatccaaaatcagaaacagggaaagaacggatgaggatcatgtcggagaccaatgacggtttcgagctgtctgaaaaggatctggaactgagaggtcccggtgatttcttcggaaaaaaacaaagcggaatgccggaatttaaagtggcggacatggttcatgattacagagcgcttgaaacggcaaggcaggatgctgcgaatcttgtggcttctgacgcgttctggaaggagccggaatacgctgtgttaagagatgaattgctgaagagcggagtaatggacggggaaaaattaagctgagtatcagaagtttttggtgttcagccagaaacaatcgttgcattccaatctatgaaattatatactactattagtacctagtcttaattgtccggatggtgtttagatatgagaagaaataagagagaacgccaggaattacttcagcagacgattcaagcaaccccctttattacagatgaagaactagcgggtaaattcggggtgagcatccagacgatacgtttggaccgcttagagctttccatacctgaactgagagaaagaattaagaacgtggcagagaaaacacttgaggacgaagtgaagtccctgtcacttgatgaagttatcggagaaattattgaccttgagctggatgatcaggcgatatccattttagaaataaaacaggagcacgtgttcagccggaatcagattgcgagaggacaccatttatttgcacaggcgaattctttggccgttgcagtcattgatgacgagctggcgctgactgcaagtgcagacatccgctttacaagacaggtaaagcagggtgaacgtgtcgtagcaaaagcgaaagtgacggctgtcgaaaaagaaaaaggaagaacggttgtcgaagtgaacagctacgttggcgaagaaattgttttttctggacgctttgacatgtatcgttcaaaacattcataaaggtggagcatgcatgagaatagctgtagatgcaatgggaggagaccacgctcccaaagctgttattgacggagttataaaaggtatagaggcatttgatgatctccatatcacacttgtcggtgacaaaacaacgatagaatcacatttaacaactacatcagatcgcatcacggtgctgcacgcagatgaagtgattgagcctacggatgaaccggtccgtgccgtgcgaagaaaaaagaactcatctatggttcttatggcgcaggaggttgcggaaaacagagctgacgcctgcatttcagcgggaaataccggtgcattaatgacagccggtctctttattgtcgggagaattaaaggaattgaccgtccggcgcttgccccgacacttccgactgtttcgggagacggatttcttctccttgatgtcggcgccaatgttgatgccaaaccggagcacctcgttcaatatgccatcatgggttctgtttattctcagcaagtgcgcggtgtcacttcaccgagagtcggacttttaaatgtcggaacagaagataaaaaaggaaacgaactgacgaagcagacgtttcaaattttaaaagaaacagcaaacatcaattttatcggaaacgtggaagcgcgagaccttttagatgatgtggcggacgttgtagtaacagacggctttaccgggaatgttacactcaaaacgctggaaggctctgcgttgtctatttttaaaatgatgagagacgtaatgacgtctactttgacatccaagcttgcagcagctgtgctgaagccaaaattgaaagaaatgaaaatgaaaatggagtattcgaattatggcggagcaagtctttttggcttaaaagcgcctgtgatcaaggcgcacggctcttcagattcaaatgctgtattccatgcgattcggcaagcaagagagatggtcagccaaaatgtggctgcgctcattcaggaagaagtgaaagaagaaaaaacagatgagtagtctggaggtttttacatcatgagtaagattgcatttttattccctggtcagggatcacaatttatcggcatgggaaaagagctttatgagcaggtgcctgctgcaaagcgtctgtttgatgaagccgatgaaacgttggaaacaaaactcagctcgcttatttttgagggggatgctgaagaattaacacttacatacaatgcgcagcctgctttgcttacgacaagcatcgctgttcttgagaaatttaaagaatctggcattacacctgatttcacagcaggacacagccttggtgaatattctgcactggttgcggctggcgctctgtctttcaaagatgctgtttataccgtcagaaaacgcggagagtttatgaatgaagcggtaccggctggcgaaggagcaatggctgcgattctcggcatggatgctgaagcattaaagcaagtaaccgataaagtcacagaggaaggcaaccttgtacagcttgcgaatctcaactgtcctggccaaatcgtcatttccggaacagctaaaggggttgagcttgcatctgaactggcaaaagagaacggcgcaaaacgcgcaattccgcttgaagtaagcggtccgttccattctgaactgatgaaaccggctgctgaaaagctgaaagaggtattggacgcctgtgacataaaagacgctgacattccggtcatctcaaatgtttctgctgacgtgatgactgaaaaagcagatatcaaagaaaaacttattgagcagctttactctccggttcgttttgaggaaagcattaacaagctgatcgcagagggtgttacgacttttattgaaatcggtcccggaaaagtgctttcaggccttgtgaaaaaagtaaatagacggttaaaaacaattgctgtatcagatccggaaacgatcgagctggcaattcaaacgcttaaggaggagaatgataatgcttaatgataaaacggctattgtcactggcgcatcccgcggaatcggccgctcaatcgcccttgatctggcaaaaagcggagcaaatgttgtcgtgaactactccggcaatgaagcgaaagcaaatgaagtggtagatgaaatcaaatcaatgggcagaaaagcaattgctgtaaaagcggatgtatcaaatcccgaagatgtacaaaacatgataaaagaaacattgtctgttttttctacgattgacattctggttaataatgcgggaattacaagagacaatctcatcatgagaatgaaagaagacgaatgggatgacgtcattaacattaacctgaagggtgttttcaactgcacaaaagctgttacaagacaaatgatgaaacagcgttcaggccgcattattaacgtatcgtctatcgtcggcgtcagcggaaaccctggacaggccaactacgtggctgcaaaagccggcgtcatcggtttaaccaagtcttctgctaaagagctcgccagccgaaatattacggtaaacgcaatagcgccaggatttatctcaactgatatgacagataaacttgcaaaagacgttcaagacgaaatgctgaaacaaattccgctcgcgcgctttggtgatcctagcgatgtcagcagtgttgtcacgttcctagcttcagagggagctcgttatatgacaggccaaacgcttcatattgacggcggaatggtgatgtaagttttttctcgaaaatttcatcatagtttctctagttttttaaaaacgaatccactataatacttgaggggaggtgaattgctatggcagacacattagagcgtgtaacgaaaatcatcgtagatcgccttggcgttgatgaagcagacgtcaaacttgaagcttctttcaaggaagacttaggtgctgattccctagatgtagttgagcttgttatggaacttgaagacgagtttgatatggagatttctgacgaagatgctgaaaagattgcaacagtcggcgacgctgtgaactacatacaaaaccagcaataagctgatgctaaaagtcccgccgaaacgcggggctttagccctttattcgtgcagttattacagcatgccgcttttacgcgcgctgtatccggtttagtcagagaagcgcggtgaacctgatgtgcctatggaggttactatgtcaaaacactcacattataaagataaaaaaaagttctataaaaaagtagaacaatttaaagagtttcaagaacggatttcggttcactttcaaaatgaaaagcttttgtatcaagcatttacacattcatcttatgtgaatgagcatcggaaaaagccgtatgaagataatgaaaggcttgaatttttaggtgacgctgttttggaactgacgatctccagattcttatttgccaaatacccggctatgagtgaaggagatttgacgaaattgagagccgcaattgtttgcgaaccgtctctcgtttcattggctcacgagctgtcattcggcgatcttgtcctgttgggtaaaggcgaggaaatgacaggcggaagaaagcgtcctgctctattggcggatgtttttgaggcatttatcggagccttgtatcttgaccaaggattagagccggtcgaaagtttcttaaaagtttatgtgttccctaaaattaacgatggtgctttttctcatgtgatggatttcaaaagccagctgcaggaatacgtgcagcgggacggcaaaggctctctggagtacaaaatctccaacgaaaaaggacctgcgcacaaccgtgaatttgaagccatcgtatctctaaaaggtgaaccactcggagtcggaaacggccgttcaaagaaagaagccgaacagcacgctgctcaggaagctttagctaaattgcaaaaacaccatacgaaacaataaaatcccccttatgactcaggggatttcagtatgtatgccgtcttatttcaccaatgtttatgatagaattgaaatacttattacataaggaggatcgctatgttcctcaaacgtttagacgttataggatttaaatcatttgcagaacggatttccgtagacttcgttaaaggcgtgacagcagttgtcgggccgaacggaagcggaaaaagcaacatcacggatgccattcgctgggttctcggcgaacaatcggcacgctctcttcgcggcggaaaaatggaagacatcatttttgccgggagtgattcaagaaagcgattaaatctagctgaagttacgcttactcttgataatgatgatcatttcttgccaattgacttccacgaggtgagtgtcacaagacgtgtgtacagatcaggtgagagtgagtttctgattaacaatcagccgtgccggttgaaggatattattgatttatttatggactctggccttggtaaagaagcattttctattatcagccaagggaaagtggaagagatcctgagcagcaaagcggaggatcgccgcagtatctttgaagaagcggccggggtgcttaaatataaaacgagaaagaaaaaagcagaaaataaactgtttgagacacaggacaatctaaatcgggtagaagatatattacatgagcttgaaggacaggttgaacctcttaaaattcaagcttcaatagcgaaagactaccttgagaaaaagaaagagctggagcatgttgaaattgcgctgactgcctatgatatcgaagagctgcatggtaaatggtcgactcttaaagagaaagtgcagatggcaaaagaagaagagcttgctgaatcgtctgctatttctgcgaaagaagcaaagattgaggatacaagggacaaaatacaagcgcttgatgagtcagtagatgagctccagcaagttttactggtaactagtgaagagctggaaaagcttgaaggccgtaaagaagtcctgaaagaacgaaagaaaaacgctgtgcaaaaccaagaacagcttgaagaagccatcgttcagttccagcaaaaagaaacggttctgaaagaagagctttcgaagcaggaagctgtcttcgaaacgcttcaggctgaggtgaagcagttaagggcgcaagtaaaagaaaaacagcaggctctcagtcttcacaatgaaaatgtcgaagagaaaatcgagcagctgaaaagtgattattttgagctgttaaacagccaggcttcgatacgcaacgaactccagcttcttgatgaccagatgtcccaatccgctgtcacattgcagagactcgcggacaacaatgaaaagcacctgcaggaacggcgtgatatttctgcgcgtaaagccgcatgtgaaacggaatttgcccgaattgagcaggagattcacagtcaagtcggtgcatatcgtgatatgcagacaaaatatgagcagaaaaagcgccaatacgaaaaaaatgaatccgctctgtatcaggcataccaatacgttcagcaagcgagagcaaaaaaggacatgcttgagacgatgcagggagatttctccggcttttatcaaggtgttaaagaagtgctgaaagcgaaagagcgccttggcggaattcgcggagcggttcttgagctgatttctacagaacagaagtatgaaacggccattgaaatagcgctcggcgcttctgctcaacacgtcgtgaccgacgatgaacagtctgcccgcaaagcgattcaatatttaaagcagaattccttcggccgggcgacgtttctgcctctttctgttattagagaccgccagcttcaaagccgtgacgcggaaacagccgcccggcattcatcatttctcggggttgccagtgaacttgtcacatttgatcctgcgtatcgaagcgtcatccagaatcttcttggaaccgttctgatcacagaggacttaaagggtgcaaacgagcttgcgaagcttctcgggcaccggtaccgcatcgtaacccttgagggagatgttgtgaaccccggtggttcaatgacgggcggcgcggttaaaaagaaaaataactccctccttggaagaagccgggagctagaagatgtgacgaaacggctcgctgaaatggaagagaaaacggcactgcttgaacaagaggtcaaaactcttaagcactccattcaggatatggagaaaaaactggctgacttaagagaaaccggggaaggcttaaggttaaagcagcaggatgtgaaaggccagctgtacgaacttcaagttgccgagaaaaatatcaatacccatttagagctctatgaccaagaaaaatctgctctgtcagaaagcgatgaagagagaaaagtgcgcaaacgcaagcttgaagaagagctctctgccgtatctgaaaagatgaaacagcttgaagaggacatagacagactgacaaaacaaaaacaaacgcaatcctcaacgaaagagtctctctccaacgagctgactgagctgaagatcgcagcggccaaaaaagagcaggcttgcaaggggaagaggacaaccttgccagattaaagaaagagctcactgaaacagagcttgcgttaaaagaagcaaaagaagacttaagcttcttaacgtcagagatgtcatctagcaccagcggcgaagaaaagctggaagaagcagcaaaacataaattgaatgacaaaacgaaaacgatcgaactgattgcattaaggcgcgatcagcgcatcaagcttcagcatgggcttgatacgtatgagcgtgagctgaaagaaatgaaacgcctgtataaacaaaaaacaacgctcttaaaagacgaagaagtcaaacttggacgaatggaagtcgagcttgataatttactccaatacttacgggaggaatacagcttgtcctttgagggggcaaaagagaaatatcagcttgaaactgatccagaggaagccagaaagcgcgtgaagctgattaaactcgcaattgaagagctgggtaccgtgaacctcggaagcatagatgagtttgagagggtcaacgaacggtacaagtttctgtcggaacaaaaagaagatttaacagaagcgaaaaataccttgttccaagtgattgaagaaatggatgaagaaatgacgaaacgctttaacgacacattcgtccaaatccgctcacactttgatcaagttttccgctccttattcggaggagggcgagctgaactgaggctcactgatcctaacgatctgcttcattcaggagtcgagattatcgctcagccgccggggaaaaagctgcaaaacttaaacctcctgtcaggcggagagcgtgcgcttactgctatagcgctcttattctcaatcctaaaggttcgtcctgtgccgttttgcgtccttgacgaagtagaggctgcgctcgacgaagcgaatgtgttccggtttgcgcagtatttaaaaaaatacagcagtgatacccagtttattgtgattacccacagaaaaggaacgatggaggaagcggatgtgctttatggcgtaaccatgcaggaatccggtgtttccaaggtaatctcagttaagctggaagaaacaaaagaattcgttcagtaacgaggaaagaggttaaaagatgagcttttttaaaaaattaaaagagaaaatcacaaaacagacagattccgtatctgaaaagtttaaggacggccttgaaaaaacaagaaactcctttcaaaacaaagtgaatgatcttgtatcccgttaccgtaaagtggatgaggatttcttcgaagagcttgaagaggttcttatcagcgctgatgtcggttttacaaccgttatggaattaatagatgagctgaaaaaagaagtcaaacgcagaaatattcaagatccaaaggaagtccagtcagtgatttctgagaaactggtcgagatttataacagtggagatgagcaaatttcagaactgaacatccaggatgggcgtttaaacgtaatccttctggtaggtgtaaacggcgtcgggaaaacaacaacgatcggaaagcttgctcataaaatgaaacaagaaggaaaatctgtcgtacttgccgccggagacacttttagagcgggggccattgaacagctggaagtgtggggagagcgtacaggagtgcctgtcattaagcagacggccggaagcgatccggcggctgtcatctacgatgctgttcatgctgcgaaagcaagaaatgccgatgtattaatttgtgatacggcaggtcgtctccaaaacaaagtaaatctcatgaaagagcttgaaaaagtgaaacgtgttatcgaaagagaagttcctgaagctccgcatgaggtgctgcttgcccttgatgccacgaccggccaaaatgcaatggctcaggcaaaagagttctctaaagcaacaaatgttaccggcattgctttaacgaagcttgacggtacggcaaaaggcggtatcgtccttgcgattcgcaacgagcttcacatcccggttaaactagtcggtttaggagaaaaagttgatgatcttcaggaatttgatccagaatcctatgtgtacggactcttttcagatttagtggaaaaagccgacgattaagaaaaaggccccaacatcttggggccttttcttttttatcttcttacttgataggcgaaatgataaaggctgttatcagtggataccagtcttgattcaccagaaaaaactctgaatgggatgatgtcatagtaatgaacggaaacagatgtgtaatacgtatagtaaccagcagctggccccaaatacattggaacctcaaatgttccgtttgcatcagtggttcctgaagcagtttgtgttgtgtttccgaccttcgtgtccgcttcaaatcttacgggcgcgtttggcactggctgtccgttttggtcgagtaatttgccgcttactgtaatattgtacttgactcgccaatattgaccttgtccgtaattgattttaccgtaaacccctccatctgtgctgatatttgtgatcgaagccttataaggtgcctcagcagcgtctgcttgctgtgccggaaaacctattgtaaacagggctgccagacataacataaacaataaaccgatttttttcataaaaatcctcctttaaatagggttcatatacaatatcggaataaattggatgatatttagcgtattttggaaaaagttaatcaccgctttgacaagataaaaacttgacagtgtcaataaaaccgtgtaaactaagttatcgtaaagggatttgacttaacaaaggggagagctcaaatgtcactcgaaaagacaacgagaatgaattatctgtttgatttttatcagtcgttgttgacgtcaaaacagaagagctatatgtcgctttattatttggacgatttctccctaggcgaaatagccgaagaatatgaggtttcaagacaagctgtttatgataacatcaaacgaacagaagcaatgcttgaacaatatgaagaaaagctgctccttttgaaaaagtttcaggagcgtaaagagatgtttaataagctgaaggagcttgcttccggttcaaaagaagaggaagaaattacagctctgattgaagcgcttgagaaattagattaggaggcggcaaactatggcatttgaaggattagccgaccgactgcagcagacgatttctaaaatccgcggaaaagggaaagtcagcgaacaagatgtaaaagatatgatgcgtgaggttcgccttgcgctgcttgaggctgacgttaactttaaagtagtcaaagattttgtcaaaaaagtaagtgaacgcgctgtaggccaagacgtcatgaaaagtctgacgcccggccagcaggtcattaaagttgttcaagaggaactgactgagctgatgggcggcgaagagagcaaaatcgccgtcgcaaaaaggccgccgactgttattatgatggtcggtctccaaggtgccggtaaaacgacaacaagcggtaagcttgcgaatctgctgcgcaaaaagcataatcgcaaaccgatgctggttgctgccgatatttaccgcccagccgcaattaagcagctggaaacactcggcaaacagcttgatatgcctgttttctctcttggcgatcaggtcagtcctgtagaaatagctaaacaggctattgagaaagccaaggaagaacattatgactatgtcattttggatacggcagggcgcttgcatatcgaccatgaactgatggatgaactgaccaacgtcaaagaaatcgcgaatccggaagaaattttcctggttgtcgattcaatgaccggtcaggacgctgtgaatgttgccaaaagctttaatgaacagctcggtttaaccggtgttgtgttaactaagctggatggagacacacgcggcggagctgcgctttctattcgcgctgtcacaaacacgccaattaagttcgcaggtttgggcgaaaagcttgatgcgttagagccgttccatcctgaacgcatggcatcaaggattctcggcatgggcgacgtgctgacattgattgaaaaagcacaggccagcgttgatgaagacaaagccaaagagctggaacaaaaaatgagaacgatgagcttcacattggacgattttctggagcagctcgggcaagtcagaaacatggggccgcttgatgagcttctgcaaatgatgccgggtgcaggtaaaatgaaaggtctgaaaaacatccaagttgatgaaaaacagctgaatcatgtggaagcaatcatcaaatcaatgactgttcttgaaaaagaacagccggatattatcaatgccagccggcggaagcggattgcaaaaggaagcgggacatccgtacaggaagtcaaccgtttgcttaagcagtttgatgaaatgaaaaaaatgatgaagcagatgacaaacatgtcaaaaggcaagaaaaaagggtttaagctaccttttatgtaatcggttatacatgataaaaccgttgttaagaaaaaacactttacaaacacttttatcattgttaatatactatcttgttgaaatattttcggaggtgctagtaaaatggcagtaaaaattcgtttaaaacgtatgggagcaaaaaaatctcctttctatcgtattgttgtagcagattctcgttcaccacgtgacggccgtttcatcgaaacagtcggaacttacaacccggttgcaaaaccagcggaagtaaaaattgacgaagagcttgctcttaaatggcttcaaactggagcgaaaccatctgatacagttcgcaacttgttctctagccaaggaatcatggaaaaattccacaacgctaaacaaggcaagtaatgactgatcaacacttggaagatttgattgtccacattgtgacgccgcttgttgatcatccagatgacattcgcgtcataagagaagaaaccgatcaaaagattgcgctgcgcttatctgtccataagtcagataccggtaaagttatcggaaagcaaggccggactgcaaaagcgattcgaacagctgtatttgcagctggcgcacagtcttctaagaaagttcaatttgaaatatttgactaaaagggagagggccggcacctcccctttttttacacgcaaaaaaagggtaaactgatagaagcttaggcaaaatagaaaagcctgggcgagaaaaagttttaaaagcggggagcttggtgcgatgcaaattattcaccgtgtagccgttatgcaagtcttaaccgagcgcagtaaagaaaagcttttagcttcttttgccgaaaagaaacaaatgcttgaacgagaatgcagccagctctattttcagcttagaaaacatgagaaagaacagcaaaaccctgatatgattgaacaatttaaaaaggcaataggaaagcgaaaagatgatataaaaatcattgattttcaaattgctcaagtacatacattgccgcttggcagtgagttgaaagaaaaggaagtcgatgcgctgctgacgattgaagccggggatgactggcatgagaaaacagcagcgaacaccatcgtcataaaagacggaaaagtaattgaaattcgccagaggtgatcatatgacaaagcgatggtttaatgtaggcaaaatcgtaaatacccacggaatcaaaggcgaagtgcgggtgatttcaaaaacagattttgccgaagaacgatacaagccgggaaacacgctgtatttgtttatggacggccgtaacgaaccagtggaggtaacggtaaacacacatagactgcataagcaatttcatctcctgcagtttaaagaaagacaaaacctaaatgaagtagaagagctgaaaaacgcaatcattaaagttcctgaagaagaattaggagagctgaatgagggtgaattttatttccacgaaattattgggtgtgaagtatttactgaagaaggcgaactcatcggaaaggtcaaagaaattttgacgcctggagccaatgacgtttgggtcatcggaagaaaaggaaaaaaagacgcactcattccttacattgaatcagtggtcaaacatatcgatgtcaaggaaaagaaaattgagattgaactcatggaagggttaatagacgaatgaaaatcgactttttgacgctgtttcccgaaatgtttgaaggcgtgctcggctcatcgattcttcaaaaagcccaggaaaaaaatgcggtgcagtttcaagtcgtaaatttccgggagtactctgataacaagcacaatactgttgatgattatccttatggcggcggggcaggcatggttctcaagccccagcctgtttttgacgcggtcgaggacctgacatcaaaggcagccgctgctccgcgtattatcctcgtatgcccgcaaggtgagcgttttacccaaaaaaaagctgaacaattagcaaaggaagagcatttgctgttcatttgcggccattatgaaggctatgatgaacgcattcgcgagcacttggtaacggatgaaatatcaattggcgactttgttctgacgggcggtgagctccctgcaatgatgatcgcagacagtgtggtcagactgcttccgggtgtacttggtaaagaggcttcccatattgaggattcattcagcaccggactcttagagcacccgcattatacaagaccggcagattacaaaggtttaaaagtgcctgaaacactcttgtcaggaaaccatgcaaaaattgaagaatggcggaataaagaatcgatcagaaggacctacctaagacgtccggatctgttgaaagactacccgcttacagagcagcaaagaaagtggatttctgaatgggaaaaagaatagattttattgcataggctatgaaattgtgataagatactacttgtggcttaagcgggcttatccgctgcaagcttgaaaacgatgttccgctgtgccggtttttgtggccaagagcatctgttggaaggagttgaaaacgatgcaaaaactaattgaagatatcacaaaagaacagcttcgtactgatcttcctgcgttccgtcctggtgacactttacgtgtacacgttaaagttgttgagggtaaccgtgagcgtatccagatctttgaaggtgttgtgattaagcgtcgtggtggtggaatcagcgaaacgttcacagttcgtaagatttcttacggtgttggcgttgaacgtactttcccagtacacacaccaaaaatcgcgaaaatcgaagttgtacgttacggtaaagtacgccgtgctaaactttactacctgcgtgaacttcgcggaaaagcggctcgtattaaagagatcagacgataatgataacgaacgaaaagagcttgttacctgtaacaagctctttttttatacagaatttgaaaatgccggacaggcatcgtaaaatacataaaggacaacaatgaatcatgcatactgaagataaaggcggtgttcgtgtcacatgacaattcaatggttcccgggccatatggcaaaagcaagaagggaagtaaccgaaaaattaaaattaatcgatatcgtatatgaattggtagatgccagaattccaatgtcatcaagaaacccaatgattgaagatattctaaaaaacaagccgcgaattatgctgttaaacaaggctgacaaagcagatgcggcagttacacagcggtggaaagagcactttgagaagcaggggatccgctctctgtctattaattctgtaaatggacaagggttaaatcaaattgtgcctgcatcaaaagagatcctccaagaaaaatttgaccggatgcgtgcgaaaggtgtgaaaccgagagcgattcgcgctttgattatcggcattccaaacgtcggaaaatcaacgctcatcaaccggcttgcaaagaaaaacatagcaaaaacgggagacagacctggcattacgacttctcaacagtgggtcaaagttgggaaagaattagagctattagatacaccggggattttgtggcctaaatttgaggatgagcttgtcggtttgagacttgcagtcactggggctattaaagactcgattatcaatttgcaggacgtggccgtgtttggtcttcgttttctcgaagaacattacccagaacggcttaaagagcgttatggccttgaggagatcccagaggacattgccgagctgtttgatgcaataggtgaaaagcggggctgtctcatgagcggtgggctcattaactacgataagacgactgaagtcatcattcgagatattcgcactgaaaagttcggcaggttgtcatttgaacagccgacgatgtaaaggcgcgcagaaatgcgggtctttatttcttcttggctgaaccgatacatacagtaagggagaagagaaagtgaatacattaaccgtaaaggacattaaagaccgtttgcaggaagtgaaggatgcacaagacccatttattgcccaatgcgaaaacgacccgagaaaaagcgttcaaacgcttgtagagcaatggcttaaaaagcaagcgaaagaaaaagcgctgaaagaacaatgggtgaatatgacttcctatgaaaggctggcaagaaacaaaggatttcgcttgattgcaggtgttgacgaggtcggccgggggcattggcaggaccagttgtcgccagcgcagtcatccttccagaggaatgtgaaatacttgggctgacagactccaaaaagctttcagagaaaaaacgcgaggaatattacgagcttattatgaaggaagcactggcggtcgggataggaattgtagaagctactgtgattgatgagatcaatatatatgaagcttcaaaaatggcaatggtgaaagcgatacaggatttgtcggatacacctgattatttgcttgttgacgcaatgacacttccgcttgatacggctcaggcgtcaattataaaaggcgatgccaaaagcgtgtctattgcggcaggtgcgtgtatcgcaaaagtgacgagggaccgaatgatgagcgcttatgccgaaacgtaccccatgtacggctttgaaaaaaataaaggctatgggacaaaagaacatttggaagctctcgctgcatacggcccaactgaattgcaccgcaaaactttcgctcctgttcaatctttcagataaatcacatggacaaggaggcacctttttaaaatgaacatacgaaatgatgtgcaaaaggcgctgcagcacctttttgggcgtacagccgtcccgcaggaaacatcaaaagtaaacgaagcgctaaacggggagaagcgtctcctcttaggaaaagtgcttcgcttactaggagatcagcatgccctgatccaagtcggcaatcaaactgttcagggaaaacttgaagcccagcttcgtcctcaggcatactattggttttcctacgaaaaaaaaacggcagaacaaacaggccgtcttcaggtcgttcaaagctttgaccaaaatcctaaaaccattcaggatgcagctggcaagcttttaaatgccatatcagtgaagacgtcaaacgcagctctcatgatgacaggagcgatgctgaagagcaaaacacccgtaacagaaaatgatatcaaaacagccgtccgctggatggacacgctgccttcgcaagacacaaaaaaagcagttgaaacggttctcttcgctttaaagcgtgatcttcccattcactccgagattttgaatggtgttcacgctgtgaaatcgcctgttccgttgcatcagcacgtatcccagctgcttcaggcaatcgaccaaaaccctcagcagagccaaatgatgtcaaagctaaaggaagcagttacggtgcttttaaatagtgaaatcgatgtccatgcagaacggctgattgataagcttatttctttaaccgacaatacgaaagcaccttctccggcgaatacagctggaagcagggagcttagcacaccagttggctccccggaaaagcaagcttgccggttgcaaatcacacagcagaacagagaagcatacaagaagagtctgttaaaacagcagcagacattccaattaaagaagcccgccagctgctgatgaagctgacggaatctgctgaaaaaaacagtctccaaattgtgaaagaagcagcaaattggattaaagcggctgcttcatcgggtgatagtaagtcacttgcagcttcagctgttttacaggcagcacaagtcacagaccaggaagccgaagtctttttaaaggctgttcagcagacagcaccccatttggcggataaggcagatgttctttctttcttatccaaagtgaaaacggcaatcggcgcaagggacgaggttgcgttcattaaagcgtttgaacaaggaagcgcagtcacatctggcgaaatgcaatccatcaagctggctctttctgccttaagagcatcgcatgaggtagccgaaccagtcaaacaagaagccgatcagctttttcataaattaaatggccagcttttcatgcagcatgaccatccgtcatacagccaaattgtaatgtcatttccgatgttttcgaagtcaggggttcaggacatgactgttctgtttaaaggaaagaaaggagcggatggaaagcttgatacttcccattgccgccttttgtttttgctgcagcttgatacactaaaagaaaccgtcgttgattgcttggtacagcaaaaagtcatgaccattacaatagagactgatttcgagctgcaggctgcgatcgatccgatggtgcccgcgcttaaacaggggctaaaggaaatggggtacagcctttcaggggtaaacgctaaaaaaagggttcacaccgaagaaaaggcttcaatcgatcaatatataacaagtatcagtgatcaggaagtggatgtgaaaatatgaaagagcagacaccgatcagaaaagctgttgctctccattatgacgaacaaaaagacaaggcgccgagagtgattgccacaggaaagggccatgtagctgacaacattatcaaagaagcaaaaaaagcaggggtcccgattcaagaagatcggactcttgtcgaattaatgcgccatttgacggtagatgatcaaattcctgaagctctttatgaaacggtagccgagattttttcattcatttacaaattggacgaaagcgtaaaaaacaaaaaatagctaaaatattccccatcctcctttgaaatttatgtttttaataaagtaaaagtttgaatgtttagaaggattaaaagattttgcatcgaactgtagacaattcttccagtaatattatagaatgaaagcgcagtctattttagttttgttacataagttaggaggatgggaaatgaatatccatgagtaccagggaaaagaagtcctcagaaaatatggggtatctgttcctgaaggtaaagtggcttttacagcagaagaagcagttgagagtgcaaagagcttatccagctcggtttatgtcgtaaaggctcaaattcatgctggcggtcgaggcaaagctggtggggtaaaaatagcaaaatcattagacgaagtaaaagcgtatgccgaagaactattagggaagaccctagttacacatcagacgggtccggacggccaagtaataaaacgcttacttattgaagaaggctgcgatattaaaaaagaatattacatcggtctagtgcttgaccgcgccacttcaagaatcgttttgatggcttctgaagaaggcggaacggaaattgaagaagttgcggagaaaacaccggaaaaaatcaaaaaagctgtcattgatccggctgtcggccttcaaggctatcaagccagagaaattgcattcgctattaatattccaaaagagctcgtgggaaaagctgctaaatttatgcttggactatataaagcgtttgttgagaaagactgctcaatcgccgaaatcaatccgcttgttgttaccggcgacggaaatgtgatggcgcttgatgcaaaattgaattttgacagcaatgcgttgtaccgacaaaaggacattatggaatacagagatttggatgaagaagatccgaaagaaattgaagcgtccaaatatgatctaagctacatttcccttgatggaaatatcggctgtatggtaaacggcgcggggcttgcaatgtccacgatggatattatcaagcattatggaggagaaccggccaacttccttgatgtgggcggcggtgcaaccgcggaaaaagtcacggaagcatttaaaatcattctttctgatcaaaacgttaaagggatttttgtcaacattttcggcggcattatgaaatgtgatgtcatcgcagaaggggttgttgaagcgactagacaagttggtttgacattgccgcttgtcgtccgtcttgaaggcacaaacgtagatctagggaagaaaatccttagtgaatcaggattaaacattacatctgcggaatcaatggctgacggcgcgcagaaaatcgtatccttagtttaagaaagaatgaaaggcaggggaccaaataatgagtgttttcattaataaagatacaagagttattgtgcaagggattacaggttctaccgctttatttcatacgaagcagatgctcgaatacggcacaaatatcgttggcggtgtaacacctggaaaaggcggaacagaagtggaaggtgttcctgtatttaatacagtggctgaagcagttcaaacgaccggcgctaacgcgtctgttatatatgtgcccgcaccgtttgcagctgatgcgattatggaagcggtagatgcggagcttgatctcgtgatttgtatcacagaacatatcccggttttggatatggtgaaggtcaaacgcttcatggaaggtaagaaaacgagactgatagggccgaactgtcctggtgtcattacgcctgaagaatgtaaaatcggcattatgcccggatacatccataaaaagggtcatgtaggcgttgtatcacgttcaggaacattaacatacgaagcagtgcaccagctctcagaagcgggtgtagggcaatctacagctgttggaatcggcggcgaccctgtaaatggaacaaactttattgacgttttaaaagcgtttaacgaagatcctgacacacacgcagtcatcatgattggcgaaatcggcggtactgccgaagaggaagcggcagagtgggtaaaagccaacatgacaaaaccggtagtcggttttatcggcggtaaaacagcacctcctgggaagcgcatggggcatgcaggcgccattatttccggcggaaaagggacagctgatgaaaaaatcaaaaccctcaatgcatgcggaatcgaagttgcagagacaccttctgtcatgggtgaaaccttaattaaggtgctgaaagagaagaacttgttcgaaacttgtaaaacgcattaataaaaaagggacagccgtcaaggctgttcctgctttttctaacaaaaggaggtcaatctattggatcaggccgctgcctgcctaacgatttgcagaatcaatcaattattatccccatcccttctattaaaatggtggaaagccgatccgtctatgtcgctgacatcacccgtgttacaaacggttactcgtgatcaaataaaagcagctgcattaaaaaacgaaatagaacaactttatccaaagctccagcgtgtacttgctgcttatcgtgagcaaggcattaacaccatccctatttcttcaaagcaatatcctttctggcttaaaagcatttatgatcccccgccgtactgtttgcaaaaggtgatatgactcttctttcgaaagggagaaaaattggaattgtagggacaagaaatccaacagcttatgggaaacaagttgtcaatcatcttacaaaagtgatctgtcgtaaaggttgggtgattgtcagcggactggcgtctgggatagacggaatgtcccatgctgcaagtattaaggcgaaggggcggacaattggcgtcattgcaggcggatttcagcacatttatccccgagaaaaccttcagttagcagatcacatggctaaacaccatatcctgctgtcagagcacccacctgaaactaaaccccaaaaatggcatttccctatgagaaaccgtattatcagcggactaagtgaaggcgttattgtcgttcagggcaaagaaaaaagcggttcactgattactgcctatcaagcattggaacaagggagagaggtatttgccgtacccggttcattatttgacccttacgccggaggtcctataaaactgatccagcagggggctaaagccatatggtcagcagaggatattttcgaggaacttcctgagagaaacgttcaatatacggaacccttttgaattatcgtttgacaaacggtattgtaatatttaataatagtgaggatttaaagttgcatattgttttctatttaattaatgacgttcatgataaagaatgaaatgttgaaagccaaataaagacagctgcaaaaataaaattgaaatatcttgaaaagagagagaacacctcttgagggggatgaaaatgtctgattatctagtcatcgtggaatcgcccgctaaggcgaaaacgattgaacgttacttaggtaaaaaatataaagtaaaagcatcaatgggacatgtccgggatcttccaaaaagtcaaatgggagttgacatagaacagaattttgaaccgaaatatattaccattcgaggtaaaggcccggtattaaaagagctgaaaacggctgcgaaaaaagccaaaaaagtgtatctcgcagccgaccccgacagagaaggggaagcgattgcatggcatttggcacacagtcttgatttagatctcaactcagactgccgtgtggtgtttaacgaaattacaaaagacgctattaaggaatcgtttaagcatccccgcatgatcaatatggatttagtggatgcacagcaagcgagacgtattttagacagacttgtcggatataaaatcagtccaatcttatggaaaaaagtcaaaaaagggcttagcgcaggacgcgtgcaatccgttgccctccgtttgattattgaccgtgaaaaagagattaacgactttaagcctgaggaatattggacaattgacggtacgttcttaaaaggtcaagaaacctttgaagcgagctttttcgggaaaaacggcaaaaaacttcctttaaatagtgaagccgatgtaaaagagattctttctcagctcaaagggaatcaatatacagttgaaaaagtaaccaaaaaggaacgcaaacgtaatcctgctttgccttttaccacttctaccctgcagcaggaagcggctcgcaagctcaatttcagagcgaagaaaacgatgatgattgcacagcaattatatgaaggaattgatttaggaagagaaggaacggttggtctgatcacgtatatgagaacggattcaacccgtatttcaaatacggctgttgatgaagcagctgcatttattgatcagacttatggaaaagagttcctaggcggaaaacggaagcctgcgaaaaagaatgaaaatgcccaggatgcccacgaagcaattcggccgacatcagttcttagaaaaccaagtgaattaaaagcagtcctcggcagagaccaaatgagactgtataaattaatttgggagcgttttgttgccagccaaatggcaccggctgttctcgatacaatgagtgtcgacctgacaaacaacggtttgacatttcgtgcaaatggaagtaaagtcaagttttccgggtttatgaaggtgtatgttgaaggaaaagacgatcaaatggaagaaaaagaccggatgctgcctgacttacaagaaggcgacacggtattatcaaaagatatagaacctgagcagcattttacccagccgcctccgcgatatactgaggcccggcttgttaaaacccttgaagaacgcggtatcggccgtccatccacatatgctccgacacttgatactattcagcggcgcggctacgtggcattggataataaacgtttcgttccgactgaattaggtcagatcgttcttgacttgatcatggagtttttccctgagatcattaacgttgagtttacagctaaaatggagagagatcttgatcatgttgaagaaggaaataccgaatgggtcaagattatcgataatttctacaccgattttgaaaaacgcgtcaaaaaagccgaatcggaaatgaaggaagttgagattgaaccagagtatgctggagaggattgtgaattgtgcagttctccaatggtatataaaatgggacgatacggtaaattcttagcttgctccaacttccctgactgccggaacacgaaaccgattgtgaaacaaatcggtgtgaagtgcccgagctgcggagaaggaaacattgttgagcgaaaatcgaaaaagaaacgggtgttttacggctgtgaccgttatccggactgtgaattcgtatcatgggacaaaccaattgaacgaaaatgccctaaatgcggaaaaatgctcgtcgagaaaaaactcaaaaaaggcatacaagtccaatgcgtggaatgcgattataaggaagaaccacagaagtagcggtgagcagggtcttgctcaccttctttgtgtgttaaaagaaggccttgaataataaactaggagatgtgaaagatgaaccaacaaacagtgaatgtaatcggagccggactcgcaggaagtgaagcagcatggcagcttgccaaacgggggattcaagtcaaattgtatgaaatgcggccagttaaacaaacgcctgcgcaccatacagataaatttgcagagcttgtctgcagcaattctcttcgctctaatacacttgctaacgctgtcggtgtattaaaggaagaaatgcgtgcgcttgattcagccattatcgctgcggctgacgaatgttcggtgcctgccgggggcgctcttgcagtagaccgtcatgaatttgccgcaagtgtgacaaatcgggtgaaaaatcatccaaacgtaaccgttattaatgaagaagtgactgaaattcctgaaggccctactatcatcgcaacgggtccgttaacatctgaatcgctgtctgcccagctgaaggagttgactggagaggactatttatatttttatgacgcagcggcgccaattgtagaaaaagacagccttgatatggataaagtgtacctgaaatcccgttatgataaaggtgaagcagcatatttgaactgcccgatgacagaagaagagtttgaccgttttcatgaagcattaacatcagcagaaacagtgccgttaaaagaatttgaaaaagagattttctttgaaggctgcatgccgattgaagtcatggcaaaacggggtaagaaaacaatgcttttcggtccgatgaaaccggttggtctagagcatcctgttacaggaaaacgcccttatgccgtcgttcagctcagacaggatgatgctgcgggaacactttataatattgtaggattccagactcatttaaaatggggagaccaaaaggaagttctcaagttgattccaggacttgaaaatgtagaaatcgtcagatatggcgtgatgcacagaaacacatttattaactctccaagcctgttaaagccgacttatcaatttaaaaaccgcagtgatctgttctttgcaggccaaatgacgggagtagaaggatatgtggaatcagctgcctcaggacttgtagcaggcattaatgcggcgaagcttgtattgggagaagagcttgtgatcttccctcaggaaacagcaattggcagtatggcacattatattacaacaacaaaccagaagaacttccagccgatgaatgcaaactttgggcttttaaaagaattgccagttaaaattaaaaataaaaaagaacgaaatgaacaatacgcgaaccgtgcgattgaaacaattcaaacaatttcgaaaacaatataggtattgattgcaacctgagcgcgatttgtgataccatttaaaagcccttcctggggaggtattaggcatggagaatgttaagaatttcgtaaagttattcgttgaatatttacaaattgaaaaaaattattcacaatatactattgtgaattatgtggattcaattgaagaattcgagactttcctgcgcgttcaaggtataaatggatttgaagaagctgcatatcaagatactaggatttttttgacagaagcctatgaaaaaggtttatcgagaagaacaataagcaaaaagatatctgcattaagaagcttttataagtttctgatacgggaaaagcttattgaagaaaatccgtttcagcttgttcatctgccaaaacaggagaaacggataccgaagtttctatatcaaaaagagcttgaggagctgtttgaagtttcagatataagccagccggccggaatgagggatcaagcgctgttagagctgctctatgccaccggaatgagggtcagtgaatgctgttccataactattaacgacgttgatttatttatggacactgtgcttgttcacggtaaaggcaagaagcagcgctatatcccctttgggtcttatgcccgcgaagcgttgaaggtatacatgaatagcggaagacagtgcttgctgatgaaggcaaaagaacctcatgatctattattcgtaaatcaaagaggcggaccgcttacagcccgtggcatcagacatattttaagcgggcttgttcaaaaagcgtcaagcactttacatatccatccgcatatgcttcgacatacgttcgccacgcatctgttaaatgaaggagcggatttgagaagcgttcaagaactgctcgggcattccaatctgtcttctacacagatatacacgcacgtttcgaaggaaatgttgagaaacacatatatgtctcaccatccaagagcatttaagaaaaattaaaggaggccctttatgtcatcttttcatgcgaccacaatatttgccgtacagcataaaggacgaagcgctatgtccggagacggccaagtaacatttggtcaggctgttgtcatgaaacacacggcacggaaagtgagaaaactgtttaacggcaaagttcttgctggctttgcgggatctgttgcagacgctttcactttattcgaaaagtttgaagctaagcttgaagaatataacggcaacttaaaacgggcggctgttgagcttgcgaaggaatggcgcagcgataaagtgctaagaaagctcgaagccatgctgattgttatgaatcaggatactttgcttctcgtatcgggaacaggcgaggtgatcgaaccagatgacggcattctcgcgattggatcaggaggcaattacgctttggcagcgggaagagcattgaaaaagcatgccggtgaaagcatgtctgcaagtgagattgccagagccgcgttagaaacagcaggcgaaatttgtgtttacacgaacgatcaaatcatactggaagagcttgaatagaaaggacttgaggcgcatggaaaaaaaaccgttaactcctagacagattgtagatcggttagaccaatatattgtcggtcagcaaaatgcgaaaaaagctgtcgccgtggcattaagaaaccgctatagaagaagtcttctggatgaaaagctgaaggacgaggtcgttccgaaaaacattttaatgatgggtcctaccggcgtcgggaaaactgaaattgccagacgaatcgctaagctttcaggtgcgccatttatcaaaattgaagctactaaatttaccgaagtcggctatgtaggcagagatgttgaatcaatggtcagagatcttgtggagacttctgttcggcttataaaagaagagaaaatgaatgaagtaaaggaacaggcagaagaaaatgcaaacaaacgcattgttcgtctgttagttcccgggaagaaaaaacaatctggcgttaaaaatccgtttgaaatgttttttggaggcagccagccgaatggtgaagatgaggcggagagccaggaagaagcaaacatcgaagaaaaaagaaaacgaatggcgcatcagctggctttaggagagctcgaagactactatgtaacagtagaagtcgaagagcagcagccttctatgtttgacatgctgcagggctcgggtatggagcagatgggtatgaacatgcaggatgcgctgagcggattaatgccaaagaaaaagaaacggcgcaaaatgacagtcagagaagccagaaaagtcctgacgaatgaagaagcaagcaaactcatcgatatggatgaagtcggccaggaagctgttcagagagcagaagagagcgggattatctttattgatgagattgataaaatcgcaaagaacggcggtgcatcttcttctgccgatgtttcaagagaaggcgttcagcgggatatcctgccgattgttgagggttcaaccgttgttacaaaatatggttctgtaaaaacagaccatgtattatttattgcagcaggagcgtttcatatggccaaaccgtctgatttgattcctgagctgcaggggcgtttcccaattcgtgtagaactgaacaaactcacggtagacgacttcgtgagaattttggttgagccggataatgcgctgctgaaacaatatcaggcattattgcagacagaaggtatatctcttgaattttctgacgaagctattcataagattgctgaagttgcttatcatgtgaaccaggacacagataatatcggtgcgagacgccttcatacaatacttgaacgcctattagaagatttgtcgtttgaagctccagatgtaacgatggagaaaataacgattacaccacagtatgtcgaagaaaagctcggaacgatagccaaaaacaaagatttaagtcaatttatattgtgaaaaatttaatatgaggaatgtttaggaggattatttatcatggctttattacaaaaaacaagaattattaactccatgctgcaagctgcggcagggaaaccggtaaacttcaaggaaatggcggagacgctgcgggatgtaattgattccaatattttcgttgtaagccgcagagggaaactccttgggtattctattaaccagcaaattgaaaatgatcgtatgaaaaaaatgcttgaggatcgtcaattccctgaagaatatacgaaaaatctgtttaatgtccctgaaacatcttctaacttggatattaatagtgaatatactgctttccctgttgagaacagagacctgtttcaagctggtttaacaacaattgtgccgatcatcggaggcggggaaagattaggaacacttattctttcacgtttacaagatcaattcaatgacgatgacttaattctagctgaatacggcgcaacagttgtcggaatggaaatcctaagagaaaaagcggaagaaattgaagaggaagcaagaagcaaagctgtcgtacaaatggctatcagctcgctttcttacagtgagcttgaagcaattgagcacatttttgaggagcttgacggaaatgaaggtcttcttgttgcaagtaaaattgctgaccgtgtcggcattacccgttctgttattgtgaacgcactcagaaagctggagagcgccggtgttatcgagtctagatcattaggaatgaaaggtacttatatcaaggtactaaacaacaaattcctaattgaattagaaaatctaaaatctcattaatcacaaaaagaaccctttttgagggttctttttttatttcaaataaaggaaatcaataagctttatttcctgggttgaaagtctttctatgtaataattttaataaattttgcatttttcttcaaaaagtttcaaaaatgccgaaaagaaaggagaaaaaacagaaattctgctattttcaggcttatatcaaggcgagaaatgtagttctaacaatctaggactttatacccagttacaaaatagataattgtgaggacatttttttacacgaacttcatagactttatgcctgttatttcttacaataagcatatagttttacaattctcgacaaggatattgagggtgaaaaaaactgaaatggaggtaagtggatttgagcttattttctggaacgatacaaaatcttgaaaatgccttgagcagagcggatattaagcaaaaagtcataactaataatatcgccaatatagatacaccgaactataaggcaaaaaaagtctctttccaaaatttattagatcaagaatcctcgcgtcttgaagcgataaaaacagactatcgtcatgttgatttttctgatactgattcgaattattcaattgttgcgagcggagatacatcgtatcagcaaaacggaaacaatgttgatgttgacaaagagatgacagaattggcgcaaaatcaaatcaactatcaagctttggttgaaagaatgaacggtaaatttaattcgctgaagaccgtattaacaggaggaaaatgatgacagcttttcatagcttaaatgtttcagcatcggctttaacagctcagcgagtcagaatggacgttgtatcatctaacttagcaaatatggatacgacaagagctaagcaggtgaatggagagtgggtgccttacagaagaaaaatggtctcccttcagtcaaaaggtgaatcgttctcttccattctcaattctcaaatgagcggaagcgggaatgctggaaacggtgtgaaggtttcaaaaattacagaggatgattcggattttaatcttgtctatgatccgacagaccctgatgcaaacgctgatggatatgtacaaaagcctaatgttgatccattaaaggaaatggttgatcttgtcagcagcaccagatcatatgaggcgaatgtcacggcgatgaatgccacaaagggaatgctgatgaaggcgttagaaatcggaaagtaggtgaatgaatgtgattaatgcaatttctccttttcaggttcaaaatactcaaaacactcaaaatgcaacaaatcaagtaaacaatagccaaaaaacagattcttcaaatcaaacaagcttttcggagcttttaaaaaactctattagttcgttaaatgagtcccaagtagcttctgacaacatgactaatgccttggctgcaggaaaagatgtaaatcttgatgaggtcatgatcgctgctcaaaaagctagcatctctctaactgcagcaacagagttccgcaataaagctgtggaagcttatcaggagattatgagaatgcaaatgtagggggtctgacgatttagagaaagagtggaatgaccggggttaacatgaatcgtactctaatgcaaatgaaaaacaaaacgagtgagttttggaaaaatagatctaaattacaaaagattttaatggttagtgctttagcggcaattattattattggaattattattagtgtttttgcttcaaattctaaaatggcgccgctgtacaaagatttgtctgccgaagaagcaggacaaatcaaagaagaattggatgcaaaaaaagtgccaaacgaactttcgaatggcggtacagtgattagtgttccggaggatcaggttgattctttgaaagtgcagatggctgcagaaggacttcctaaaaccggatcaattgattattcattttttggacagaatgccggctttggtttgacagacaatgagtttgatatggtgaaagtaaaagctacacagacagaactgtcaaacttgatcaatgaaatggacggtattaaaagttcaaaagtaatgattaatctcccgaaagacgcggtgtttatcggtgaagagcaatctgcagcatctgcatcaatcgttttgcagattcaaccgggttatacacttgatcaaagccagatcaacggattatatcatctggtatctaaaagcgtgccgaacctaaaagaagataacatcgtcatcatggatcaaaattctacatactacgacaaatcagacagtgatgcagggtcctacgcggatagttattcttctcagcaaggaattaagtctcaagttgaaaaagacattcaaaaacatgtacagtcacttcttggtacgatgatgggccaagataaagtcgttgtctccgttacagcagacattgatttcacaaaagaaaatcggacagaagacattgtcgaacctgtggataaagaaaacatggaaggcattgcagtcagcgctgaaaaggtatctgaaacatatcagggcgacggtgcagccaacggcggaactgccggaaccggcgaggaagatgtaacaaattataaggctgacggtgaaaataccgaaagcgggaactacgaaaaaaacagcaacaaaatcaattacgaggttaaccgaattcataaagaaatcgctgaaagtccttataaggtcagagatttagggattcaagtaatggtagagccgcctgatgccaaaaacacagcgtcgctatcaactgaaagacaggatgatatacaaaaaatcctttcaactgtagtcagaacatctttggataaagatgaaacgcaaaaccagaatttatctgatgctgatatcaataataagattgttgtctccgtacagccattcgacggaaaagtcaatttggatacaaatacggaaaaatcctcaggtatcccgctgtgggcatatattgtaggcggtgttttaatcgcagcgatcattgttctgatcattatgcttatcagaaagaaacgggcgcaagaggatgaatttgaggaatatgagtatgaggttcctcaagaaccaatcaatttgcctgatatcaacgaagaggaaaatgaaacagcggaatcagtcagacgaaaacagcttgaaaagatggcgaaagacaagccggaagattttgcaaaactgctgagaagctggctggccgaggattaggaggaattagaaatggcgagacgtgatcaagataagcttacaggaaaacaaaaagcagccattctcatgatttccttggggttagatgtgtcagcttctgtctataagcacttaaccgatgaagaaattgaaaggcttactctggaaatatcaggtgttcgaagcgtcgatcatcaaaaaaaggatgaaatcatagaagaatttcataatatagccattgcgcaagattatatttctcaaggcggtttaagctatgcaagacaagttctggaaaaggcgcttggagaggataaggcggagaacattctaaacaggctgacttcttctttgcaggttaaaccatttgattttgccagaaaagcggagccagaacaaattttgaattttatccagcaagagcatccgcagacgatggcgttaatcttgtcttatttagatccagtgcaggccgggcaaattttatccgagctgaaccctgaagtgcaggctgaggttgcgagaagaatcgcggtcatggatagaacgtctccagaaataattaacgaggtagaacggattctggaacaaaaattatcttctgcatttactcaggattatacacaaacaggcggaattgaagctgttgtggaagtgttaaacggggtagacagagggacagagaagacgatcttggattcattggaaattcaggatcccgatcttgctgaagagattaaaaagcggatgtttgtcttcgaagatattgtcacacttgataaccgtgcaattcagagagtcattcgcgatgttgagaacgacgatttgctcctttcattaaaggttgcaagcgaggaagtcaaagaaattgtgttcaacaatatgtcacagcgtatggttgaaaccttcaaagaagaaatggaatttatgggccctgtacgcttgaaagatgtagaagaagcacaatcgagaattgtaagcatcgtcagaaagcttgaagaagccggtgaaattgtgatagcaagaggcggaggggatgatattattgtctaatatcattaaacaagaatcatctatttctccacaaaaggaaaaaagaaaactttctatacaagaggtgcgtattgatcattctcaccttttgcaggctgaagagaacccggaggcgcttatggcccgagtgaaagaggaagctgaccggatttctgagcaggcaaacagtcatatagaaaatattcgccgtcaaattgagcaggagaaaaacgattgggcggctgaaaaacagaagcttattgaagaagcaaaaaccgagggctttgaacaaggagtagcgctgggcaaagctgaggcaatgaaacagtatgccgaactgatcggccaagcaaacagtataactgaaatgtccagaaaagctgttgaggacaagcttgaagacgctaatgaagaaatcgttgagcttgccgttgccctagcaaaaaaagtttggcagcaaaagtctgatgataaagaggcttttctcctgcttgtacaacaggttataaacgaagtgaaggaatatgacgatatatcaatttatgttgatccatattactatgagacaatctttcagcaaaaagatgaaatccagcagcttctttataaagaatgccggcttggcatatatgctgatgaaaaagctcaaaaaggaacctgttatattgaaactccttttggcagggtagatgcgagtgttgacacacaattgatgcaattgaaagataaacttctgacagcgctggaagcaggtgcagctgaatgaagacacagagtctgatagattgtatagaaatgacagactcgtataaacggtacggaaaagtcaagcgggtaatcggcctgatgattgaatcaaaagggccagcaagctcaattggcgacgtgtgcctgatttatgcaaaaggacaatctgggaaagtcattaaagctgaggtagtcggcttccaggaagaaaatattttgcttatgccttatttagaggctgcgagcattgcacctggcagcattgtagaagctactggggaatcacttcgggttaaagttggaaccggactgatcggacaagtcatcgatgcttttggagaaccccttgacggaaagcttctgccgaaagggctttcgcctgtatcaacggagcaatcaccgcccaacccgatgaaacggccgcctatccgtgaaaagatgggtgttggagtcagatcaattgacagcttgctgacagtcggtaaaggccagcggattggaatttttgcaggaagcggtgtcggaaaaagcaccttaatggggatgatcgccaagcagacagaggctgacttaaacgtcattgcacttgtcggagaacgcggacgagaggttcgggagtttattgaaaaagatctggggaaagaggggctgaaacgatcgattgtagtcgttgccacctcagaccagccagcattaatgagattgaaagcggcatatacagcgactgccattgccgagtatttccgagataaaggccaaaatgtcatgtttatgatggattctgttacaagggtggcaatggcgcagcgagagattggactggctgctggggagcctccgacgacaaaaggctatacaccttcagtgttcgctattttacctcgtttactagaacgaacgggtgcaaacgagcatggaaccattacggcattttatacagtgttggtagacggggatgacatgaatgagccgattgccgataccgtacgcggaattttagatggacatattgtgttggacagggcgcttgccaataaaggccagtttcctgcagttaacgtactaaaaagcatcagcagggtgatgtcaaacatttcaacaaaacagcatctggatgcggcaaataaattccgtgaacttttatcgacatatcaaaattcggaagatctcattaatatcggagcttacaaaagaggatcatccagagaaattgatgaagcgatacaattttatccgcagcttattcaatttttaaagcagggaacagacgaaccggctttattggaagaaagcattgctgcattaactagtttgacaggaaatgaggaataaacgtggcttatcaatttagattccaaaagctgctggaactaaaagaaaatgaaaaagaccaatccttatccgagtatcagcaatcagtttctgaatttgaaaacgttgctgaaaaattatatgagaatatgagcaaaaaagaattgctggaacaaaataaggaaaagaaattaaaaagcggcatgagtgtacaggaaatgaggcactaccaacaatttgtctcaaatcttgataatacgatctatcactatcaaaagcttgtcattatgaaaagaaatcaaatgaatcaaaaacaagaaattttgacagagaaaaacattgaagtgaaaaagtttgaaaaaatgcgtgaaaaacagtttaaaatgtttgctcttgaagataaagctgcagaaatgaaagaaatggacgatatttcgattaagcagtttatgattcaaggccattaggagcgaatgtaatgtccggcaaaaagaaagaatcaggtaagttccgttcggttttgcttatcattatcctcccgctgatgtttctattaatcgcagggggattgttctttgggctgctggtatcaatgtcttaaagccgatacaggatgctgcggcaaaaacgccggttcttaaagaattggtccctgaaaccgaaaataaaaaaggcgcagcatcaagtaaggatagcagtaatacggcagctctggaaaagaccattaaggatcaaaaaagtgaaatcagtatattgaataaagatttagaaacaagcaaatcagaaatcgacaggctcaatcaaaagatccgttcacttgaaaagacggctgaggatcaaaaaaagtcatcagaagatcatactgaaggatcagcagactcgaaagcttcttctgaaaatgacaaagtgatcagtgtgtacaaaagcatggacagcggaaaggctgctaaaattattgcccaattaaaggagcaagaagcactgaaaatattgaatggcctaagcaaaaagcagcttgctgacatattggcgaaaatgactcctgagcaagcagcaacctatacagaaaaaattgctgccagccaagaatagggggaatgaaaggtgaagctgcttgaattagccggacctttactgcaaaccacaacgggttctgccgctaaaaacatgaaaagtagccagggagtttttcaaaactggcttatgtctgagactggattgaaggaactttcagaacaaggaaagggaacttctaattccgaagatcagcttttagcagatgcgcttaaaaagatcggtgaatggctaaatgcaagtcctgaagttcaagacaaacaaaatgcggatcttttgcaaacattaagcaaactgacagggaagcaattggatgcgaatgctctgcaaatgttgcaaaatcttttgcaagcagttgaatcaaaaatgtcaggcgggacggatcaattgctcacagaaacggagaaaattttttcagaagctaaaacggctctgagtgccaatgattctgcttctgacattaatggagcactgaagtctgatacagagcaatcaaatcaggaaaatgaagtatccgaggctgctaaagagctcatctatatccagatgttcattagccagctcgtagaagggaataagctgactgatcgcgggaatggcaatgaagctcatgccatttaccaaaatggagatcaattcctttctgcattagaaaagaagggtgtatctcaacaactaattcaggatcttaaacagcaaatattcactaaagctgagtcaagttcaaaacttcactcgatgacagcgtcagagctgaaaagctttcaaagcttaatggatcaaatgtctatgcttcctcaaaaagggaccaaagaatggagtttagctgaaagccagctgaaagccttcttgttatcgaaatcatccgaatcatcacaagactttgggaagcgtgttctcacaccgctctcgcagagttcatccagcacaaatgcatcggatgtttctggaagtattcagcctatagatagtaaatcaggactccaaatgctgttttcggggtatcggagcataggaggagttcaaacacttgatctgcagcagatgtcatctgatataccaaatgccgaaacaaaaacggtggctgatcaagtgattaatgcgtggaagcagatgaaatatacgcctttcggcagatcgacgggaagtttcactattcggctgaaccctgaacatttaggatttgtcacaatcaagctgacaaatgaaaatggaatgtttcagagtaaaatcatagcatctagccaatcagcaaaagaattgcttgaacagcatcttcctcagctgaagcaatcattgccgaatatggccgtccaaattgaccgttttactcttccggtccaaagcggggatcagccgatatacggccagcttgctgatgaacagaaacagcagcaagaggggcagagacagcaaagacagaaaaagcaatcaaatgattttggcgatctgctcgatgaagtgtcgatggttgaaatggaggaagaagaatgacttctataagttcagaatataaactgcctgaaaaaacgaacactgtgtcgacgaacaacagcagcttggggaaagacgagtttttaaaaatattaatgactcaagttcaaaaccaagatccgcttaacccggttgacgataaagaatttatcagccagatggcgactttttcaagcttggagcaaatgatgaatctgaatacgacaatgactcaattcgttgaaaaccaagatccgtttacaacgtatgttgattggatgggaaaagaagtatcttggactgatggcaaaagtgcaacagataaaacaggcacagtaagctctgttaaacattttaaaggaaattattatctcgttcttgatgatgggaccgagatcagtcctgcgaatgtcatgtctgtgggacaatcatctaaataaaaacatctgggggaatatattatgttacgttcactttattctggaatcagcggtatgaaaaactttcaaacaaagcttgacgtaatcggcaataacattgccaacgtaaatacagtaggattcaaaaagagccgggttacctttaaagatatggtaagccaaacgattgccggcggttctgctgctggtgcaacaatcggcggaacaaactctaagcaaatcggtttaggttcatcatctggcacaattgatacaattcattcaacaagcgcgacacaaagcacaggaagaacacttgatttagcaattgacggcgacggttacttccgaattgatacaggtgacgggacagcttatacaagagcagggaacttctatttagataataccggaacattggttacaggtgatggctaccatgtactaaatatgaatggcggaacaattaaaattcctactgatgcacaaagtttcactatcggttctgatggcaaggtatcgatcgttgatgccggtggtcaatcacaagacggcggacaaatcgggattgtgacttttgccaacagtgacggattggataaaatcgggagcaacttataccgtgaatctttaaactctggtacggccagtgcagcgaaccagcccggtgatggcggaacaggttcccttaaagtaggatttctcgaaatgtctaacgtcgatttaactgacgaatttactgaaatgatcgtagcccagcgcggattccaatcaaactcaaaaattattacaacatctgatgaaatccttcaagaactggttaaccttaaacgttaaggagggaggggaggcgagtaatcgcttctccgctgttttatgattaaagtaacccgtttgaacgggcagccctttacactgaatgcgctatttattgaacagattgaatgttttccggatactacaattactctgtcaaatggtaagaagtttgtagtaaaagaagatgaagaagctgttctggaaaagatcgcagctttctaccgaaaaatacaaatatttgcaatggatcaaggaatagaggaaccggaatgaagaaaaagttaatgatcatattactaattattcttatcgtaattggtgctctcggggcggcggcttattttgttttaggcggaaagtccgaaaaaagtgaagcgaaaaaaagtattgatgaaatcgttgcgtcttctgttgatgtagaagagatcacaacaaatttaaagtctgataacattatccgtcttgctattaaacttgaaactgattctgataaatcaaaagaagaacttgagaaacgtgatttccaagtgaaagacgctgttatatcactgctggctgatacgaatgctgatcagattgagggagacaagggaaaagaaacctttaagaaggaactaaaagataaaataaatagctacctccaagaaggaaaagtagaaaaagtgtatattacctcctttaatctgcaataaagcataatttgacagaatacggaggtgaggaaaatgtcaggagaagttctctcccaaaatgaaatagatgcactgctttctgcaatatcaactggtgaaatggacgctgaagagctgaaaaaagaagaaaaagagaagaaagtcaaggtttatgatttcaaacgtgcgctgcggttttctaaggatcagattcgcagtttaacgagaattcatgacaattttgcaagacttcttaccactcatttttctgctcagctcagaacctatattcacatatctgtcagttctgttgatcaggttccgtatgaggaatttatcagatcgattccaaacatgacgattctaaatctatttgatgttcatccgatggaaggaagaattatgatggaggtcaaccccacgatagcttatacgatgatggatcgagtcatgggcgggattggaatcagtcataacaaggttgacagtttgacagaaattgaaacaaaaatcatttctaatttatttgaaaatgcactgggtaattataaagaagcttggcagtcaattgctgatattgaaccggaaatgactgagtttgaagtgaatccgcaatttgttcagatggtatctcctaatgaaacagtcgtggtgatctcgctcaatactcaaattggtgaaatcagcggtgtcattaatctctgtatcccgcatattgtactcgagccgctcataccgaagctttcagtccactattggatgcaatcagaccgaaatgagccaaagcctgaggaaacaaagtcgcttgaaaaacgtatcatgacagcacaaatacctgtcgtggccgagctcggcacatctgaactgacgatagaagagtttttaagtttagaagtcggagactgcataactttggacaaatcagtcacggatcctcttactgtattggtcggagataagccgaaatttttaggacaagccggccgggtgaatcgaaaacaggcagtgcaaattttagatcacgacataagaggtgaacaagatggagaataatagattatctcaagatgagattgacgcgcttcttaacggtactggcagcacgcttgatgagccagaggttccggaagtagatgacttatcggaaatggagcgtgatgcgatcggtgaaatcggtaatatttcattcggcagttctgcgacagcactgtcaacgcttttaaatcaaaaggtcgatattacgactccaagcgtaacggtcattccaagaagtaaaatcagcgatgcgtttcctgaaccgtatgtagcgattgaagtgaattatacggagggcttcagcggaagcaacctgttagtcgtggaacaaagtgacgcggcgatcattgctgacttaatgatcgggggagacggaaaaggtgcggacccttcactgggtgaaatccatttaagtgcggttcaagaagcaatgaaccaaatgatgggatcggctgccacatcaatgtctactgtattcagtaaaaaaattgatatttcacctcctcgggttgaattgctggatgttactgaagaaaagggtacagaccgtattcctgatgatgaaatgctggtgaaagtttctttcaacttaaaggtgggagaattaatagattccagcattatgcagctttacccattgacatttgcgaaagatttaatttcaagccttatgaactcagaaagtgcagaggaagaagaaacggtgcagcctgaagttacatacgaacagccgaaagagcctgtgacgccagagccgcgtattgaaccgaagcaacagcagcagccgccaaaaaggcagggaacagcaaaaaaagcagcgccagttcaggtttcaccggtggaattttcagcgtttgatccaaacgaagctgtacaagcccctattcataatctggatatgcttttggatatcccgctttcaattactgttgagcttggcagaacgaagagaagcgtaaaagagattttagagctttctgccggaagtattatcgagcttgataaattagccggtgagcctgtagatattttagttaatcagcgtatcgttgccaaaggcgaggtcgttgtcattgaagaaaacttcggagtaagagtcactgacattttaagccaggcagagcgcattaataatttaaaataacgaaacacaaggagagagatagattatggcacatagaattttaattgtagatgacgcagcatttatgcgaatgatgattaaagatattttggttaaaaatggttttgaagttgtggcggaagctgaaaatggagcacaagcggtagagaaatataaagagcattcacctgaccttgttactatggatatcacgatgccagaaatggatggtattacagcattaaaagaaattaaacaaattgatgcgcaggcaagaatcatcatgtgttctgctatgggacagcaatcaatggttattgatgccattcaggccggcgctaaggatttcattgtgaaacctttccaggctgaccgtgtgcttgaagcaatcaacaaaacattaagttaaagggtgtacgactgttgaaaaagagtcaatattttatcgtttttatttgttttttcgttttattcagtgtacatccgattgctgctgccgcggcagactctgataattcaactgtaaacgaatggtttcaaaagaaagatgaaaaaactgcggataagtcagagcaaaagaaagaaaaaacaacaaaaactgctgatgagacggagggagcggctgctccttctgtctcagcttttgattttgtaaagatgattttcgctttactgtttgttatcgtgctgatttacgggctggttaagctcatgaacaaaagaaatcggctcctaaagccttttcaatatgttgaaaatattggcggcacatcggtcggccagaacagatccatacaattgatcaaggtcgggaaaagtgtgctcgtcgtcggtgtaggagagacgatccagctgctgaaagaaattgaggatgaaaaagagattgaagtcattctcagtcagcatgaagaggcaatgtcaagcaaaatagagtggcaaaagtttgtgaagccgcataagagttctgaacatcagccgcagcaaaaactgccttcattttcaaaagcattaaaagagcaacttgaagagttaaaacaaaaccgttctgaaggaaagaagaaaggcccacgtcatcatgaatgagtttataaatattttcagttcaagcgatccggaaaacgtaagttcaactgttaaattactattattgttaactgtattttcagtggcgcctggaatattgattcttatgacttgttttactcgcatcgtcattgttctgtcatttgtcagaacttcacttgcgacgcaatctatgcccccaaaccaggttcttatcgggcttgcgctgtttttaacattttttattatggctcctactttttcagaaattaataaagaagcgctgaccccattaatggacaacaaaatcagcttggatgaagcgtatacgaaagctgaggaaccgattaaagaatttatgagtaaacacacaaggcagaaggatctggcgctgtttatgaattacgcgaaaatggataaacctgaatcattaaaggatattccgctaacaacaatggttccggcttttgccatatcggagcttaaaacagcatttcaaataggttttatgatttttatcccttttttaattatagatatggtagtggcgagcgtcttgatgtcaatgggaatgatgatgctgcctccagttatgatttctctgccctttaaaatattactttttgttttggtagacggctggtatttaattgtgaaatctttgcttcagagcttttagggtaggtgctaaacgtgagttcagaatttgtaatttctatggcggaaaaagccgtatacgtaacgctgatgatcagcgggccattattggctattgctttactggtcggtttaattgtcagcatatttcaggcgacaactcaaatccaggaacagactttggcgtttattccgaaaatcgtggcggttctcctggctctcattttttttggtccgtggatgctgtcgacgattctttcatttacaacagagctgttttctaatttaaatcgttttgcagggtaatgtagagatgaattcaattattgacttatttcctgcttttttattggtttttattagaatctctgctttttttgtaacgattccgctatttggacatcggaatgtgccagctgttcatcgcataggatttgctttttttcttgcagtcatttgtttcagcaccattgataaaccgccctctttggagatagatgagcactatatgctcttggcgtttaaagaagctttggtcggcctatgtctgggtttaattgcttatatgatgattgccgcagtgcagattgccggctcgtttattgattttcaaatgggattttcaatagcaaacgttattgatccgcaaaccggtgcacaaagtccgttgattggccagtttatctatacgatggcacttttgtttatgctgagtgtcaatgcccaccatttgctgctagacggtatttactacagctttcagtatatttcagttgatcaggcatttccgaatttcggcgatgaaaagtttgcctattttatcgcgaaaagctttaatgcaatgtttattatcgcttttcaaatgtcagcgccggttgtggccagtttgtttctagttgatttagcattaggtatcgtggctcgaactgttccgcagttaaatgtatttgtggtcggtctgcctttaaagatcgctgtcagtttcatcatgctcattgtatgtatgtccgttatcttcgtcgttgtccggaatgttttcagtttaacgattgaaacgatgcggaatcttttagcattggtcggtgtttcttaatgaagcttagagttgacctgcagttttttgcgggagagaagacagaaaaagccactccgaaaaaacggaaggatacgcgaaaaaaagggcaagtagccaaaagctcggatgtcaataccgccgtttctttactggtaatattcctttcgcttattgcaattggtccgtatatgagagacaggctgctgtcattcatagaaacattttataccgaatctctcacaatgaagctctcagaatcaaatgtgcatacattgtttgtcagcttattaaaggatatgggcatgatactcgcaccgatcttgcttgttgctcttgttgcaggagtcgtaagcaactatatgcaggttgggttcttattttctgctgaagtgatacagcctaagcttgaaaaactggatccgatcaaaggctttaaacgaatatacagtatgagggcgattgtagagctgattaaatcaattttgaaaatcgtagtcgtcggttttgcggcttttgctgtgctttggctgcattatggagaaattctccggcttcctctcctgacacccgaagaggcactttctttcgtttcaaaactcactttgtggatgggactaagcggtgcaggtgcattgttgattcttgcgggtctcgactatttatatcagagatttgactatgagaaaaatatcaaaatgtcaaaacaagatataaaagatgagtacaaaaaatctgaaggagacccgattatcaagtctaaaattaaacaaagacagcgggaaatggcgatgaggcggatgatgcaggaagttccaaaagcagatgtcattatcacaaacccgactcactatgcgattgctttgaaatatgatgaagaaaaaatggacgcaccttatattgttgcaaaaggcgtcgaccaccttgcgttaaaaatcaggaaaattgctaaagagcatgatgtcatgatggtagaaaacagaccgcttgcccgtgcgttatatgatcaagtggaaattgaccaggcagtgccggaagaattttttaaagttttagcagaaattctggcttacgtatataaaacaaaacaaaaagtatattgaatttttcgatttaaaaggagagaaaaaacagcatgtcaacaagagatttatccgttttaataagtgttgtcctcattgtggcgatgctggtgattccatttcctccatggctgttaagtattttgatcattattaatatttctcttgcgttgatcgtgcttctcaccacaatgaatatgcaggaagcgcttcagttttcgatttttccgtcactgttgctgcttttgaccctatttcgtttgggcttgaacgtctcaactacccgttcaattctttcacacggtgaaggagggaaagtcgtcgagactttcggaaatttcgttgtcggcggaaatgtattagttggactcgttgtatttatcatccttattattattcagtttatcgtcattacaaaaggtgctgaacgtgtttccgaggttgcagcaaggtttacgctggacgcaatgccggggaagcagatgagcattgatgctgatttaaacgcagggatgattaccgaacaggaagcgaagcatcgccgcgaaaaagtggcaagagaagcagacttttatggagcaatggacggtgccagtaaatttgtaaaaggtgacgccattgccggaatcatcattgtgatgatcaatattattttcggaatcgtgatcggaatgcttcagcagggcatgtccattcaagaggctgcttcacactttacgatgctgactgtaggggatggaattgtttcgcaaatcccggcactgttaatttctacggctacgggtattgtggtcacaagagctgcctctgaaggaaacttagggcatgacattacaggccagctgtttgcgtatccaaagcttttgtacgtcgcagcagctacgatcatgcttttaggtattttcactccgatcggcatccttctgacggggccgcttgcgggattgcttgcttttggcgcatatacactatctaaatcaggtaaggaaaaagaagaagtggatgagattcttgaggaagaggctgaggtggacgagcttaaaagccctgaaagtgttgttcagcttctacatatagatccgatagaatttgagtttggatatggcctgataccgcttgctgatgccaatcaaggcggtgatttattagaccgaattgttatgatacgccgtcagttggctttggaactcgggcttgtcattcctgtcgtgcgaatcagagataatatagcgttgcagcctaatgaataccgattgaaaattaaaggaaacgaggtagcaaaaggcgagctgttgcttgatcattatttagcgatgtcgcctactcctgaggacgatctcattgaagggattgaaacagtggagccttcattcggactgccggctaaatggattagcgaagcggtaaaggatgaagccgacatgcttggttatacagtagttgatcctgcatcagtcgtttcaacgcatattacggagaaaattaagcagcatgcccacgaattgatcggaaggcaggagacaaaacagctgatcgatcacttgaaagaatcgtatccagtcctggttgaagaggttacgccgaatccattgtctgtcggtgaaattcagaaagtgcttgctaagcttttaaaagaaaaagtttcaattcgaaacttagtaacgatttttgaaacacttgctgactatgggaaattaacaacagattctgatctcttgacagagtatacaagacaagcgcttgctaaacaaattacagcccagtttgccaaagaaaatgaagtgttgaaggttgttacttgttcgggccgtgtagaaaaagcaatagcagacggtgtgcagcagacggaacacgggaactatttatcacttgaaccagatatttcagaaagtatagtacgctctgtcgccaaagaagctgaacagctctcattacgtcaggaaaccgcgattcttctttgctcgccgcctgtcagaatgtatgtgaagcagcttctggaacggtacttccctgatcttccggtactctcttataacgaacttgaggcgaatgttgaggtacaaagcattggagtggtggatatttaatgaaaataaaaaaatttactgctgcttcaatgcaagaagcggcacttctcatcagaaaagagttaggtaatgaagcggtcatattaaattcgaaaaaaattaaaaagcgaaaatggtttggcctcgtcaacaagcctgctgttgaagtaatcgccgtattggatcaggactttcttgagaaaaaaacgcctcagaaggcagctgaaccgaaacaaacattaaaaactccggtcagcagtccgaaaatagaggagagaacatatccccctcaaattccggcgcaacaggagctaggtgatttttcagcatatcaatctgtacttcctgagccgctgcgaaaagcagaaaagcttttgcaagaaacagggatcaaagagtctacgaaaacgaacactctgaaaaaattgcttcgcttctctgttgaagcaggcggcttgactgaagaaaatgttgtcggcaaacttcaggaaatactatgcgatatgctgcccgcagcagacaagtggcaggagccaattcattcaaaatatatcgttctctttggttcaacaggggctggtaaaacaactacacttgctaaactcgcagccatatctatgcttgaaaaacataaaaaaatcgcttttattacaacagatacgtatcgtattgcagctgttgaacagttgaaaacatacgctgaactgctgcaggctcctctggaagtttgctatacaaaagaagaatttcagcaggcgaaggagttattttctgagtatgatcatgtgtttgttgatacagccggaagaaacttcaaggacccacaatacattgatgaactaaaagaaacgattccttttgagagcagcattcagtcatttcttgttttatccgcgactgcaaaatatgaagatatgaagcatattgtcaaacggttttcatccatccctgttaatcagtatatttttacgaaaatagatgaaacgacttccttaggttctgtatttaatatactggcagaatcaaaaataggtgtcgggtttatgacaaacggacagaatgtgcctgaggatatacagactgtatctccacttggttttgtgaggatgctgtgcagatgaacagatatgaccaagcagcaactttacgggcgaaaatggaaaaacgtgagcgcgttctgccgatgatttattcacaaaaagcgaagacacttgctgtcattagcggcaagggcggtgtcggaaaatccaatattaccttaaatatggcacttgcgctgcaggataaaggtaagaaggtgctgctcatcgaccttgatatcgggatgggaaacattgatatattaatgggaaattcatcgtctgccacgataatcgatgttttaaccgatcgtaagcctttgctgcagtcattatccgttggcccaaagggtttgcggtatatatcagggggaaccggtcttgatgtgatgtttcagctcgatcagagaaaatggacgttttttgccaatgaactttctcatgcattaagccagttcgattatgtgctgtttgatatgggagcgggcttatcaaaagatcaactgccttttattttatcagcagaagatattttgattataacaactcccgagccgacggccattatggacgcatacagcgctgtcaagcacttggttttgacagaaaataagctttcaatgaaggtggctgtcaatcgatgccgtgaccaaaaggaagggcttgacgcttttgcccgcctctcccgtacaattcatatgtttttggatgttcaggttcagtttgccggttccgtttctgacgatgtgatcgtgagcaaagcggttgtcgaacaggttccttttttcataaaaagccctcaggcaaaagccagccggtcagtccgtattttagcggacgccttgtttgaaagagaagaaacgagacacaaagaagacaaacagacatttattgagaaattatcttcttttttaatgaggagggcttaatttgattcgtgtgcttgtagttgatgattcagcttttatgagaaaaatgataagtgattttctgaccgaggaaaagcagatagaagtaatcggaactgcgagaaacggagaagaagcgcttaagaagattgaattattaaaaccggatgttattactcttgatgttgaaatgccggtcatgaatgggacagatacgctccgcaaaattattgagatttataacttgccggtcattatggtgtctagccagaccgagaaaggtaaagaatgcacaattaattgtttggagatcggtgcctttgactttatcacaaagccatcaggctcaatatctctggatctatacaaaattaaagaacaattagttgagcgtgtcgtcgcggcaggactttccggcaagcagaaacgtcctgtttcccagacagttcggcccgaacctattgtgcgtgctgtcgttaagcctgaattaagcaaaccgaaacctggcacgggcagacaaattgtgtgtatcggcacatcaacaggcggtccacgggcgttacaaaaggtgataccgaagctccctaaggatttgaacgcaccagtggttgtcgttcagcacatgcctgaagggtttactgcttctttggctgatcggctgaatcatttatctgacattcaggtaaaagaagcaaaagatggtgaagcagctcttaacggctgtgtttacatagcaccgggcggaaaaaacatatccgttattaaaaacagcgaaggactccagattgtgcttgataaccatgacacaccaagccgtcataaaccatctgctgattatttattccgttctgtcgggaaactgacagattatgaaaaagtagcggttatcatgaccggaatgggcagtgacggcactgctgggctaaaggacatgctaacagccggcaatgtgaaagccattgcggagtctgaagaatcttgtgtcgtatacgggatgccaaaagctgctgttaaagcgggtctcattcatgagattaaacatgtggaagatatcgcagcatccatcacaagctgtgtgaaaaaagagagggtgtgattcaaatggatatgaatcagtatttagatgtctttattgatgagagtaaagaacatttacaaacatgtaatgaaaagcttctccttttagagaaagacccgactgatcttcagctcgtacatgatatattcagggctgcccatacattaaaaggaatgagcgcaacgatgggctacacggatttagcacatctaacccatctgcttgaaaacgtgctggatgcaatccgaaacggagacatggcagtcacctcagactggctggatattttgtttgaagctctggatcacctggaagcaatggttcagtctattattgatggcggggatggtaaaagagatatctcagaagtgagtgccaagcttgatgtgaatggtgcgcacgctgaatccgccgcctccgcggaacctgcagaagcacagagttcagcatctgattgggaatatgatgaatttgaacgtacagttatacaagaagcggaggagcaaggcttcaaacgttatgaaatcaagatttctctgaacgaaaactgtatgttaaaagcagttcgtgtctatatggtgtttgaaaaactaaatgaagtcggagaagtagccaaaacaattccaagtgctgaagtgcttgaaacagaagattttggaactgattttcaagtttgtttcttaacacatcaatcagcggaagacattgaacaattaatcaatggcgtgtcggaaattgagcatgttgaagtcattcaaggggctcctttaacatcagctgaaaagcctgaagaatctaagcaagaagattcaccagcagcagttgtacctgcgaagcaggagaaacaaaaacagcctgctaaaaacgatgaacaggcgaagcattcagccggcggatctaaaacaattcgtgtcaacattgacaggcttgattctttaatgaacttatttgaagagcttgtcattgaccgcgggcgtctcgagcagattgcaaaagagcttgagcacaatgaactgactgaaacggttgaacgaatgacgagaatttccggagatttgcaatcgattattctgaatatgagaatggtcccggttgaaaccgtttttaacagattcccgagaatgattcgccagcttcagaaagagctgaataaaaaaattgaactctcgatcatcggtgcggaaactgaactggatcgtacagtaattgatgaaatcggagatccactcgttcacttgatcagaaacagtattgaccatggtatcgaggcgccggaaacacgtttgcaaaagggaaaaccggaatcaggaaaagttgtgcttaaagcttatcacagcggcaaccatgtctttatcgaagtagaggatgacggcgcaggccttaatcgcaataaaattctggaaaaagcgcttgagcgcggggtcataacggaaaaagaagctgaaaccttagaagacaaccaaatttacgaattgatttttgctccggggttctcaactgctgaccaaatttctgatatttccggccgcggtgtcggacttgacgttgtaaaaaacaaactggagtctcttggcggttcagtcagtgtgaaatcagccgagggtcaaggctctctattcagcatccagctgccgcttaccttgtctattatttcagttctgctgattaagttggaagaagagacatttgccattccgatttcttcaatcattgagacagcagttattgacagaaaagacattttgcaaacgcatgaccgtgaagtgattgactttagagggcatattgtccctgtcgtttatttaaaagaagagtttaaaatagaagatacaagaaaagatgcggaacagctccatatcattgtcgtgaaaaaaggcgacaaacctactgcatttgtggtggactcctttattggccagcaggaagttgtgctgaaatcactcggagattatttaacaaacgtctttgcaatttccggagctactattttaggagacggagaagtagcgctcattattgattgtaatgcactgattatttaaccattcgaggaggtgtctcacatgactgcagaaattaaaacaggcgaaaaaatgatagtctttatggtaaatggcaaagaatatgccatttccgtcactcaggtgaaatcaattgaaaaatggcaaaagccaacgagggtacctggcgtcgaaccatatatttgcggggtaatcaatttacgcggggtggtgactccggttattgatttaagaaaacgcctgaatttgccagagtatgaaattaccgatgaaacacgaattatcattattgcttatcgtgatattgaagtcggctggattgtggatgaagcgaatgatgtgattaccgtacacgaaagtgaaatagaatctgctccagaaggcgttcagaaagatacggatgtgtcgatcgaacagattgtgaaacaagagaacagactcttaaatattattgatgcgaacgcggttttggataaggaatcatctcagtccgctgtgcccgatcaagcttaatcttaaaggggttatgacatgagtatttttaatggaatcaaagaagagcagatggacattttgcgggaagtcggcaatataggcgccggccactccgcctctgcaatggcccagctgttaaatagaaagatagatatggaagtcccatttgcaaagctgctgtcttttgatgagcttgttgattttttcggcggtgccgatgtcccggttgccagtatctttttaagaatggaaggcgatttaacgggttcaatgttctttataatgcctttttttcaggcggagcagtttatcagagaactgattggaaaccccgactttgacatagaggacttaggtgaagaccacatgagctcatccgctttgcatgaactgggcaatattttagcggggtcatatttaacagctttggcggatttgacgaaactccagctctatccaagtgttcctgaagtctcattggacatgttcggagctgtgatcagcgaagggctgatggagctcagtcaggttggagaacacgccattgttgtcgacacgtcaatttttgaccaaagccatcagcaggagctgaaagcgcatatgtttatgctgccggactatgattcatttgaaaagctctttgtcgccttaggtgcatcattatgagtacaactgaggctgttgttataaaggttgggattgctgacgtgaagatcgcccgcttcccggataccattcggacctctgggttgggctcatgtgtggggctggtgctttatgataaagaaaagcaaacggcgggtcttgttcatgtcatgcttccggattcgacgttatcgaaaactgccgagctcaaccgggctaagtacgctgacaccgccgtaaagaccacgattgatatgctgatagaagcgggatgccggaaatttgcattaaaagcaaagctggccggcggatcagagatgtttaaatttaaatcgacaaatgatttgatgaagatcggaccgagaaatgtattagcgataaaagaacagctgtctttatttaatattcctattattagtgaagatacgggcggctcaagcggccggacgatagaatttgaaccgaagtcctgcatgctgcatattcgaactgttaaacaaggtgaaaaaacgatttaattaaggtattagggggataacaatgcaatccttgaattatgaagatcaggtgctttggacgcgctggaaagagtggaaagatcctaaagccggtgacgacttaatgcgccgttacatgccgcttgtcacatatcatgtaggcagaatttctgtcgggctgccgaaatcagtgcataaagacgatcttatgagccttggtatgcttggtttatatgatgcccttgaaaaatttgaccccagccgggacttaaaatttgatacctacgcctcgtttagaattcgcggcgcaatcatagacgggcttcgtaaagaagattggctgcccagaacctcacgcgaaaaaacaaagaaggttgaagcggcaattgaaaagcttgaacagcggtatcttcggaatgtatcgcccgcggaaattgcagaggaactcggaatgacggtacaggatgtcgtgtcaacaatgaatgaaggtttttttgcaaatctgctgtcaattgatgaaaagctccatgatcaagatgacggggaaaacattcaagtcatgatcagagatgacaaaaatgttccgcctgaagaaaagattatgaaggatgaactgattgcacagcttgcggaaaaaattcacgaactctctgaaaaagaacagctggttgtcagtttgttctacaaagaggagttgacactgacagaaatcggacaagtattaaatctctctacgtcccgcatatctcagatccattcaaaggcattatttaaattaaagaatctgctggaaaaagtgatacaataatgaatttcatggttagcgagtgaaaaacatgtcaacactattatggcttttaagctttacgctccacggcgttcttctgtacgctgtcattatcctgtatacgaggctcgctgcagtgaaagaaacagaaaaacagcaaaaacagatacttgaagagacggaaaacaccttggcggcatttctgcttgaattaaaagaagaaaatgagaaactgatagaaaataaagcttcatctgcaagtcaatcagatgaagaatcccaaaaaccaggcattcagcactctgaaacatatcaagagcgggatccagttcaagaggcagagaatcttcctgaacatattgaaggtctgattacagaggttgaccgtcgggaagagatcgtaaacagtgaggtccaatcatttgaagaccaggtcatagaattatatgaacagggatattcggcaagtcagattgcccagaaaatgaagagcggaaagacagaaatcgagctatttttaaaatttcgctccaaaggtgtaaaggattcttgattgtcggataaagctgtgttatattatgtcttggtgttaaatacacacgcttaacgatttatgcagagggtgctgcaggcggcagttctgcacaaaaatgacctaagcggaggaaaaaaaccattatattaggaggaaataacatgtcagtcatttctatgaagcaattgcttgaagctggtgttcacttcggtcaccaaacacgccgttggaacccaaaaatgaagcgttacattttcacggagcgtaacggaatctacatcattgaccttcaaaaaacagtcaaaaaagtagaggaagcttacaacttcactaaaaatcttgctgctgaaggcggaaaaatccttttcgtcggaacaaaaaaacaagctcaagattctgttaaagaagaagctcaacgctctggcatgtactatgtcaaccaacgctggttgggcggtacattaacaaactttgaaacaatccaaaaacgtattaaacgtcttaaagacattgaaaaaatgcaagaaaacggtacgtttgatgtacttcctaaaaaagaagtcgttcaattgaaaaaagaattagagcgtcttgaaaaattcctaggcggaattaaagatatgaaggatcttcctgatgcattattcatcatcgatcctcgcaaagagcgcatcgctgttgcggaagctcgcaaattaaacatccctatcatcggtatcgtagatactaactgtgatccagatgaaatcgatgttgttatcccagcgaacgatgacgctatccgcgctgttaaacttctaacttctaaaatggcagatgcaatcttagaagcgaagcaaggcgaagaagaagcggaagttgctgaagaaactgcaccagaaacagaaacaacaactgcgtaacctattcaaaaggtgataagagggactgccttttatcaccttttttcaagaaaaatgtgtaatatacatactcttgtttaaacatataaggaggaatacaaatggcaattactgcacagcaagtaaaagaactgcgtgaaaaaactggcgcgggcatgatggattgtaaaaaagcgttaactgaaactgacggagatatggacaaagcaattgaccttttaagagaaaaagggattgcaaaagcagcgaaaaaagctgaccgtatcgcagcagaaggttctactcttattaaaactgacggtaacaaaggcgttatcctggaagtaaactctgaaactgatttcgttgcgaaaaacgaaggcttcaaagagcttcttaacactttagctgaccaccttcttgcaaacacgccagcagatgttgaagaagcaatgggtcaaaaaatggaaaatggctcaactgttgaagagtacatcacaagcgcagttgctaaaatcggtgagaaaatcactcttcgtcgctttacagttcttacaaaagacgaaagctctgcattcggtgcgtaccttcacatgggcggccgcattggtgtattaactgttctcaacggtacaactgatgaagaaactgcgaaagatatcgcaatgcacgttgctgcagttaaccctcgttacatttctcgtgatcaagtatctgaagaagaaacaaatcatgagcgtcaaatcttaactcagcaagccctccaagaaggcaaacctgaaaacatcgtagcgaaaatggttgaaggccgtctgaacaaattcttcgaagaaatttgtctattagaccaagcgttcgttaaaaacccagatgaaaaagtgaaacaagttattgcagcgaaaaacgctactgttcaaacttttgtccgctatgaagttggagaaggcatcgaaaaacgtcaagaaaactttgctgaagaagtaatgaaccaagtgaaaaaataatggtgaaaagatttcgcggctaagtcgcgtcttttcaggcagtataggggacacattttgtgttccctatttttaaaactatatttacaaacctttttttctcttgcataatagaaaacggcaatgtttacacttggaggttatcatggaaaaaccaaaatacaaacgtatcgtattaaagcttagcggggaagcattggcaggagaacagggaaatggaattaacccgactgtcattcaatccattgcaaagcaagtgaaggaaatcgctgagcttgaagtcgaagtggctgttgtagtaggcggcggcaacttatggcgcggaaaaacaggaagtgacctgggcatggaccgcgcgactgctgactatatgggaatgctggcgacagtaatgaattcgcttgctcttcaagacagcttggaaacactcggaatccagtccagagtgcaaacatccattgaaatgagacaagttgctgaaccgtacataagaagaaaagcgatacgccacttagagaaaaaacgtgtcgttattttcgctgcgggcacaggaaacccatatttctcaactgatacgacagctgcactgcgggctgctgaaattgaggcagacgttattttaatggctaaaaataacgttgacggtgtgtataatgctgatcctagaaaagatgaatcagctgttaagtatgaatcactttcttatcttgacgttcttaaagacggcctggaagtcatggattcaacagcttcctctttatgtatggacaatgacattccgcttatcgtcttttctattatggaagaaggaaatatcaaacgtgccgttatcggtgaatcaatcggaacgatcgtgagggggaaataacgtgtcaaaagaagtattaactcaaacaaaagaaaaaatggaaaaagcaattgctgcttatcagcgcgaattggctactgtacgcgcaggccgtgcaaatccatcattattagataaagtaacggttgaatattacggagcgcagacacctttaaatcagttgtcttctattaacgtgcctgaagctcgtatgctcgttatcacgccatacgacaaaacagcaatcggcgatatcgaaaaagcaattttaaaagctgatttaggtcttacaccaacaagtgacggcaatatgattcggattgcaattccggcactaacagaagagagacggaaagaattagtgaaagttgtaaaaaaatatgctgaagaagcaaaagtagctgttcgtaacgttcgccgtgatgctaacgatgatctcaaaaaacttgagaaaaacggagacattactgaggatgaactgcgtgcttccactgaagacgttcaaaaactgacagatgaatatgtgtcaaaaattgacagtgtcacaaaagacaaagaaaaagaaatcatggaagtttaatgaaaaactatgtacaatagataatagtgaaaagaccctctcatgtttacagggggtttttttgttaatactgttgattacattgattatcagcagggaatgtaacctttttgggtgacggaggaatctcatgctcaacatactcaaaaattggaagaatcagcaaactgcggcttccaacttagaacgttatacaaaagaagacatacttaagggagaaattcccgaacacatcgccattatcatggatggaaatggccgttgggctaaaaaacgctctcttcccagaattgcaggccaccatgaagggatgaaggtggtaaaaaggaccacgaagctcgcaaacgaattaggtgtcaaagtactgacattgtatgcattttcaacagaaaactggaaaagaccgaaaatggaagtcgattttttaatgaagcttccggaagaatttttgaatacgtatcttccagagcttgttgaggaaaatgtacaggttcggatcattggggatgaaacggctttgccggcgcacacattacgtgcgattgaaaaagctgtacaggacacggcgcaaaacgacggaatgatccttaattttgctcttaactatggaggccgtactgaaattgtcagtgctgcaaaatcactcgcggaaaaagtgaaggaaggctctttgaatattgaagacattgatgaatcgcttttttctacttatttgatgactgaatctttgcaggatcctgaacttttaattcgaacgagcggcgagataaggctgagtaattttatgctatggcaggttgcctacagtgaatttgtctttactgacgtcttgtggcctgactttaaagaagaccacttcttgcaggcgttaggagagtttcagcagagaggccggaggtttggcggaatttagaggatggtggacatgaaacaaagaattttgacaggtgttctggcagcaattgtatttttatttttggttattgtcgggaaattgccgttcaccatattaatttatgctatgggcagtgtggcgctttttgaacttttacggatgaaaaagctgaagctggtttcactgccgggtttgatcggtcttttattattgtggatgttcttattgccaagccagtattcgttttttgaagcggacggaatttccaaaatggaaatcgctttatttgcggtattgctattgctgacttacacagtgttggtcaagaacacctttacttttgatgaagtcggatttattacgcttgcagcaatttacatcggaatgtgttttcattattttatcgaaatcagaaatcttgaccaatacggattaacatacattttttatgcgtgtgttgtcatttggtccaccgattccggtgcctattttgtcggtaaatcgcttgggaagcggaaactgtggcctgaaatcagtccgaataaaacagtggaagggtttgcaggcggaattgtcatcgcacttgtattggcgacgatttttcagcttgttgcacaacttccgatcccgtatatctatctgctgttgatcacgctgtttttgtctgtttttggacaactgggagatttagtggaatccgcgttgaaaagacattacgatgtaaaggattctgggaatattcttcctgggcatggcggtatattagaccgttttgacagtttcttgtttgtcatgcctttcttgtactttctgcttgcccttttttcataaaaaagtctagtatgaatatgagactgatcatgcagcaataagaataggagtagtggcaactttgaaaaatatttgtcttttaggagcaacaggatcaatcggcgaacagactcttgatgtactgcgtgcacatcaagatcaatttcagctggtatctatgtcgtttggcagaaatattgataaggccgttccaatgattgaggtctttcagccgaagtttgtctctgtcggtgatctggatacatatcataaattaaaacaaatgtctttttcttttgaatgccaaatcgggctgggagaagaaggactgatagaagcagcagtgatggaggaggttgacattgttgtcaacgctttgcttggaagcgtcggccttatcccgacgttaaaggcaattgaacagaaaaaaacaattgcgcttgcaaataaggaaactcttgtcactgcagggcatatagtaaaagaacatgctaagaaatatgatgttccgctgctgcctgttgacagtgagcattcagccatttttcaagctcttcaaggcgaacagactaaaaacattgaacgcctcatcattacggcatccggcggaagttttcgggacaagacgcgggaggagctcgaatcagtaacagttgaagatgcattaaaacatccaaactggtcaatgggtgcaaaaattacaattgattcggctacaatgatgaataagggattagaggtgatcgaggcacactggcttttcgatataccttatgaacaaattgatgtggttttacataaggagagcatcatccattcaatggttgagttccatgataaaagtgtgatcgcacagctcggaactccggatatgagagtccccattcaatatgcgctcacttatcctgaccgattgccattaccagatgcgaaaaggcttgaattatgggaaatcggcagccttcattttgagaaagctgattttgacaggttccgatgcttacaatttgcttttgaatcaggtaaaataggaggaacaatgccgacagtgctaaatgcggcaaatgaagtagctgtcgctgcctttttagctggcaagataccgtttttggctattgaagactgtatcgaaaaggcactaacccgccatcaattactgaaaaaaccgagcctggcggacattcaagaagtggacaaagatacccggggatacgtcaattcaatactcacataaggtggtatgttcgtgaatacagttatagcgtttatcattattttcggaacgctcgttttcttccatgaactgggccatttattgctagcccaaagagcgggaattctctgccgtgaatttgcgatcggcttcggtccaaagattttttctttcaaaaaaaatgaaacagtttatacgatcaggctgcttccggtcggcgggtttgttcgtatggccggcgaagatccggaaatgattgaggtgaaacccggatacacggtcgggcttctctttaataaagaagatcaagttgagaaagtcatcatcaatcaaaaggaaaaatatccggatgctttagtcattgaagtggaaacagcggatctagagcatgacatgaagatcacaggttatgaacaggggaaagaggacgaactttccagctttactgtcagcgaaacatccttttttattgtagacggagaagaagtgcagattgcgccgtataatcgccaatttggttccaaacctgtgtggcagcggattaaagcaattgctgcagggccgattatgaactttattttagcttacgtcattttagtgatgcttgggctgattcaaggcgtaccgtcaaatgaacctatgctcgggcagctgacagacaatggacgggcggctgaagcagggctaaaagaaggggattatatccaaagcattaacggagagaaaatgaggtcttggactgacattgtctccgctgtaaaagaaaacccggataaagaaatggacgttgcagtaaaaagagataacaaaacgcttcatatttcagtgactccggaagctgttaaagatgagaacaaaaaaacaatcggacgtttcggttcctatgcgccgactgaaaaaggcgtcctctcagcagttgcttacggcgcgacatcaacagttgatgtcactaaagcgattttaaccaatctgagcaaattagtaacaggccaatttaaactcgatatgctgtcaggtcctgtcggcatatatgatatgacagaccaagtggcgaaaacagggatcgtgaacttatttcagtttgcggcgtttttaagcattaaccttgggattgtcaatctgcttccgattccggcacttgacggaggaagactgttgtttctatttattgaagcgattcggggcaaaccgattaacagggaaaaagaagcatttgttgtgtttatcggagtagctttcttaatgcttcttatgctggttgtcacatggaacgatatccagcggctgtttttgtaaacgaaaagtaaatcaatcagaggtgcgaagaaatgagacaaagcttgacgcttattcctacgctccgtgaagttccagctgatgccgaagcaaaaagtcatcagcttcttctgagagcaggatttatcagacagaatacgagcggggtatacagctatatgcctctggcgtataaggtgattcaaaacattcagcagattgttcgagaggaaatggagaaaattgatgccgtagaaatgctcatgcccgcattgcagcaggcagagacatggcaggaatcaggcagatggtatacgtatggtcccgaactgatgaggctaaaagaccgtcatggccgtgaatttgctttaggggcaacgcatgaagaggttatcacttcgcttgttcgcgatgaggttaaatcttataagcgtctccctctgactctttatcaaattcagtctaagttcagagatgaaaaacgtcctcgcttcggtttgttaagaggccgcgaatttattatgaaggatgcgtactctttccatgcatctgcagagagtctggatgaaacgtatcaaaaaatgtacgaagcctattctaatatttttgcccgctgcggcattaatgtaagacctgttatcgctgattcaggcgcaatgggaggaaaggatacgcacgaatttatggcactttctgcgatcggagaggatacgattgcgtattctgatgaatcacagtacgcggctaatatcgagatggctgaagttcttcaccaggaagttccttcagatgaagagcctaaagctctagagaaggttcatacgcctaacgtgaaaacaatcgaagaactgactgcgttcttgcaggtttcggctgaagcgtgcattaagtcagtattgtttaaagctgatgaccgttttgtcttagtgcttgtaagaggggatcatgaagttaacgatattaaagtgaaaaacttgcttcatgcagaagttgtagagcttgccacacatgaagaggtcattcagcagctcggaacagagccaggttttgtaggccctgtcggtattcatcaggatgtggaagtatatgccgatcaagctgtgaaagcaatggttaatgctgttgccggggcaaatgaaggagatcatcattataaaaatgtcaatgtgaatcgtgacgcgcaaattaaagaatttgctgatcttcgttttattaaagaaggtgatccttcaccagacggcaagggaacgatccgttttgctgagggaatcgaagtcggacaagtctttaagctcggaacacgctattcagaagcgatgaatgcgacatatttagatgaaaacggacgcgcgcagccaatgctgatgggctgttacggaatcggtgtgtcaagaacgctttctgctattgctgaacagcatcacgacgaaaaaggcttaatatggccaaaaagcgttgcgccgtacgatcttcatattcttgcattgaacatgaaaaacgatgggcaaagagagcttgctgaaaagctgtatgccgatttaaaagcggaaggctatgaagtgctctatgacgaccgtgctgagcgtgccggcgtaaaattcgctgattcagatctaatcggccttccaatccgcatcactgtcggaaaacgggctgacgaaggaatcgtcgaagtgaaaattcgccaaactggtgagtcaactgagatttcagtagacgaattatctgcgtttatcagcaagcagtaatcaccataacgatttatcaaaaaacatgttaaaatagaaataatagaaggtacctcattgcctgaggtaccttcacttatgatgtttttagggagggatactgtcttaatggaacagttatcagtaaacagaaggcagtttcaaattcttctgcagcagattaatatgacagatgataccttcatgacatactttgaacatggcgagattaaaaagctgacaattcacaaagcttctaagtcttggcattttcattttcaatttaaatctttgctgccttttcaaatatatgacacattaacaacgaggctgacgcaatcgtttgcccacatagcaaaagtgacatcttcaattgaagttcaggatgccgaggtcagtgaaagtatcgttcaagactactggtcacgctgcattgaagaactgcagggcatttcgccgccgattatcagtcttttaaaccagcaaaaaccgaagctgaagggcaataaactgattgtcaaaaccaaaacggatacagaagcggctgcgctaaaaaacaaatacagttccatgattcaagcaggctaccgtcaatttggctttccggatcttcagcttgatgctgaaatatttgtatccgagcaggaagttcaaaagtttcgggaacaaaagcttgcggaagaccaagagcgggcgatgcaggccttgattgaaatggagaagaaagataaagaaagtgatgaagaccaagcaccatctggtcctcttgttatcggttatcaaattaaagataacgaggaaatccggacacttgacagcatcatggacgaagaacggagaattacggtccaaggttatgtgtttgatgtggagacgcgcgagctgaagagcgggcgcacgctgtgtatcttcaaaattacagactatacaaatagtattttgatcaaaatgtttgcacgtgaaaaagaagatgcggcactgatgaagtctctgaaaaaaggaatgtgggtaaaagcacgcggaagcattcaaaatgatacatttgtcagagaccttgtcatgatcgcaaatgacgtaaacgaaataaaagcaaaaacccgtgaagattcagcacctgaaggagaaaaaagagtggaattgcatcttcattccccaatgagccaaatggatgctgttacgggtatcggaaagcttgtcgaacaggcgaaaaaatgggggcatgaggccatcgctttgactgaccatgctgtcgttcaatccttccctgatgcgtattctgcggcaaaaaagcatggaattaaaatgatttacgggatggaagcgaatctcgtggatgatggcgtgccaattgcttataatgccgcacatcgtctgctcgaagaagaaacatatgttgtttttgacgttgagacgacaggattgtctgctgtatacgataccattattgaactggctgcagtaaaagtaaaaggcggagaaattattgataaatttgaggcgtttgcgaacccgcatcgtccgctttccgccacaatcatagagctgacagggatcactgatgatatgctacaagacgctccggatgtcgtagatgtaataagagatttcagagaatggattggcgatgatatccttgtcgctcataatgcaagctttgatatgggattcttaaatgtagcctataaaaagcttcttgaagtcgataaagctaaaaacccagtcattgatacgcttgaacttggacgttttctctatccggaatttaagaaccaccggttgaacacactttgtaaaaagtttgatatcgaactcacacagcatcaccgtgcgatctatgatactgaggcaaccgcttatttgcttctgaaaatgctgaaagacgcagctgaaaaaggcattcagtaccatgatgagttgaatgaaaatatgggtcagtccaatgcttatcaaagatcaagaccgtatcatgcaacattacttgccgtgaacagcacgggacttaaaaatttatttaagcttgtgtcactttctcatattcattatttttacagagtgccgcgtattccgagatctcagcttgagaaatacagggaagggctgctgatcggttctgcctgtgacaggggagaggtttttgagggaatgatgcaaaaatcgcctgaagaggtggaagatatcgcgtcattttatgattaccttgaggttcagccgcctgaagtgtatcgtcacttgctggagcttgaactggtccgtgatgaaaaagcgctgaaagaaattattgtgaatatcacgaagctggggaaaagcttaataaaccggttgttgcgacgggaaatgtccattacttgaatgatgaggataaaatctacagaaagattttaatatcctcacaaggcggggcaaatccgctgaacaggcatgaactgccgaaagtgcatttcagaacgacagacgaaatgcttgaagctttttctttcttaggtgaagaaaaagcgaaggagatcgtagtcaccaatacccaaaaggttgcttctttagttgatgacatcaagccgattaaagatgatttatatacgccgaaaatcgaaggcgctgatgaagagatcagagaaatgagctatcagcgtgcaagaagcatttacggggaagagctgcctgaaattgtcgaagcgcggattgaaaaagagttaaagagtattattggccacggatttgctgttatttacttgatctctcacaaacttgtaaaacgttcactagatgacgggtatctcgttggttcccgtggttccgtaggatcttcattagttgcgacacttactgagattactgaggtaaacccgctgccgccgcactatgtttgtcctgagtgccagcattctgagttctttaatgacggttctgtcggttctggttttgacctgcctgacaagacatgccctcattgcggaacgcctttgaaaaaagacggccatgatattccatttgaaacgttcttaggatttaaaggggacaaagtacctgatatcgatttgaacttctcaggggaatatcagccgcaagcacacaattacacaaaagtattgttcggagaagacaatgtatatcgtgcgggaacaataggcacggtggcagaaaaaacagcctacggttatgtaaaaggctatgccggagacaacaatcttcatatgcgcggtgccgaaatagatcggctcgtacagggatgcacaggtgtaaaacgtacaactggacaacaccctggcggtattattgtagttccggattatatggatatttatgatttttcaccgatccagttcccggcagatgccacaggttcagagtggaaaacgactcattttgatttccactccatccatgacaacctgttaaaacttgatattctcggacacgatgacccgactgttattcggatgcttcaagacttaagcggaatagatccgaaaacaattccgacggatgatcctgaagtgatgaagatcttccagggaaccgaatcactcggtgtgactgaagaacagattggctgtaaaacgggtactcttggaattcctgaattcggaacccgatttgtccggcagatgcttgaagatacaaagccgaccactttttctgagctcgttcagatttcaggcttgtctcacggaactgatgtatggcttggcaatgcacaggagctcatccacaataatatttgtgagctgagtgaggttatcggctgccgtgatgacattatggtttatttaatctatcaaggccttgaaccgtcccttgcctttaaaatcatggaattcgtgcgtaaaggaaaaggattaacgcctgaatgggaagaagaaatgaaaaataacaatgtcccagactggtatattgattcctgtaaaaagattaaatacatgttcccgaaagcccatgccgcggcatatgtcttaatggcagtccgcattgcttactttaaagtgcatcatgctcttttgtattatgcggcttattttaccgttcgtgcagatgactttgatatcgatacaatgatcaagggctctacagcaatcagagcggtaatggaggatataaactctaaaggacttgatgcttcaccgaaggaaaagaaccttctgactgttttagaattagcgcttgagatgtgtgagagaggctattcattccaaaaagtcgatttatatcgctccagcgctacagagtttattattgacggcaacagtcttattccgccgtttaactctattccaggattagggacgaacgctgctttgaacattgtaaaagctcgcgaagaaggcgaattcctctcaaaagaagatttgcaaaagagagggaaagtatcaaaaacgattttagagtacttagatcgccatggctgtctggaatcactgcctgatcaaaaccaattgtcattgttctaatatggaaagcagaatttctcagaaattctgcttctatgcatacataagcgcaaaaagtgccatcgtaatattagagtttctgtacttgcttaggtatgaaggtaagcgtatatccatttgcaataaaaatatggttatggtatagttttattggaaatgctaacgattaccgaggcaaagagtggggaaacccgctcttttgtattgaacaggagaattttgtctcgacatgttcatcgtttactttttagcccctgctcttttgaagcagggtttttatgcagagtgacgagacgaatatgagatcgacagcacaaggaggaagaacatgagcaaaaaagtgactgacaccgttcaagaaatggctcagccaatcgtagacagccttcagctggaactcgttgacattgaatttgtcaaagagggccaaagctggttccttcgcgtgtttattgattccgatgacggtgtggatattgaggaatgtgccaaagtaagcgaagctttaagcgaaaagcttgatgaggcagacccaatcagccaaaattactttcttgaagtctcatctccaggagctgagcgtccgctaaagaaaaaagccgatttcgaaaaatcactaggaaaaaacgtatacattaagacgtatgagcctattgacggcgtaaaagtgtttgaaggtgaactggctgaatttgatggacaaacagtgacagttgagatcacgatcaaaacaagaaagaaacggatcaatattccgtatgaaaagatagctaatgcaagattagctgttacattctaatgaatacaaatgttttaaggggggagaccgttaaatgagcagtgaattattagatgctctcacgattcttgaaaaagaaaaaggcatcagtaaagaaattatcatcgaagcaatcgaagctgcgttaatttctgcttataagcggaattttaatcaagcgcaaaatgtacgggtggatctaaaccgtgaaactggctccatccgtgtatttgcaagaaaagatgtcgttgacgaagtatacgaccagagattagagatctcaattgaagaggcgcagggcatccatccggaatatatggtcggcgatgtcgtcgaaatcgaagttacacctaaggatttcgggcgcatagctgctcaaacagcgaagcaggtcgtcacacagcgtgtgcgcgaagctgagcgcggtgtgatttattctgaatttatcgaccgtgaagaagacatcatgacagggatcgtccagcgtctggacaataaatttatctacgtgtctttaggcaaaatagaagccttgctgccggttaatgagcaaatgccgaatgaaagctacaagccccatgaccgcattaaggtatatatcacaaaagtagaaaaaacaacgaagggcccgcagatttatgtgtcaagaacacatccaggcctgttaaagcgtttgtttgaaattgaagtgcctgaaatttatgatggaactgtcgagctaaaatctgttgccagagaagccggcgaccgttcaaaaatttctgttcgcacagatgatcctgacgtggatcctgtcggttcatgcgtagggcctaaaggccagcgtgtgcaagcaatcgtcaatgaattaaaaggtgaaaaaattgacattgtcaactggtccagtgatcctgtagaatttgtcgcgaatgcgctcagcccttccaaagtgcttgatgtcattgttaatgaagaagaaaaagcgacaactgttattgttcctgattaccagctgtctctggcaattggcaaaagaggacaaaacgcacgcttagctgctaaactgacaggctggaagattgatattaagagcgaaacggacgcaagagaacttggaatctatccgagagaacttgaagaagatgatgagccgctctttacggagcctgaaactgctgaatcggatgaataagaggtgactttaggtgaataaacacaaaaagatcccattacgcaaatgtgtagtgactggtgaaatgaagcctaaaaaggaactgatccgagttgtacggtcgaaagaaggcgaaatctcagtagacccgaccggaaaaaagaatgggcggggtgcttatttaacgctggataaagagtgcatcttagcagcaaaaaagaaaaacactttgcaaaatcaatttcaatcacaaatcgatgaccagattttcgatgaattgctggaactggcggaaaaggtgaaaaaataaaatgtctggaatggaatggtttcccttgctgggtctggccaatcgagctcgtaaggtcgtgtcaggcgaagacttggtaataaaagaaatcaggaatgcgcgtgcaaagcttgtcctgcttacagaggatgcatcatctaacacagcaaaaaaagtaactgacaagtgcaattattataaagtcccttataaaaaagtcgagagtcgcgcggttcttggacgctctatcggtaaagaagcccgtgtcgttgtcgccgtcactgaccaaggttttgcgaataagctgatcagcttgctcgattaatatttttgggggtgaacgaatggctaaaatgagagtatacgaatatgcaaaagcgttaaatgtttcaagtaaggaaattttgaccgcactgaagaacatggatttagaagtgaataatcacatggccatgcttgaagaaaaggccattaaaaagcttgatgccaaatataaaaaaggcggcgcagctgctaaatctcaaaagccagcagaaacgaacaaaaacaaacagccacaaggggttaatcagcaatcagctggaaatcaaccaaataaaattcgagacggaaagaagaatgacgtgcagaataatcaatttaacaaaaacaagaagaataacaacaacaaaaaaaataaacgcaacaacaacaacaataaaaaccaacatcagcaaaagcctgtaaagccgaaaaaagagcttcctgagaaaattacattctctggcactttaacagttggcgcacttgctgaagagcttggcaaagagccttcagaactcattaaaaagctgatgcttcttggcgtaatggctaccattaaccaagagcttgataaagacacaatcgaactcattgcatcagaatatggtgttgaaacagaagaggtcattgtgcttgaagaaacagagctggaaaaatacgaagagcctgataatgaagaggatcttgaaattcgtcctcctgtcgtgacaatcatgggccacgttgaccatgggaaaacaacgcttcttgacagcatccgtaaaacaaaggttgttgaaggagaagcaggcggaatcactcagcatatcggcgcttatcaaattgaagagaacggcaagaaaatcacgttcttggatacaccgggccacgccgcatttacaacaatgcgtgcacgcggtgcagaagtaactgatattacgattcttgtcgtagctgccgatgacggtgtcatgccgcaaacagttgaagcgattaaccatgcaaaagcagcagaggttccaatcatcgtagctgtgaataaaatagataaagaatccgcaaaccctgaccgtgtgatgcaagaactgacggaatacggacttgtccctgaagcttggggcggagaaaccatttttgtgccgctttctgctttaactggaaaaggcattgatgagctcgttgaaatgattttgcttgtcagtgaggtagaggaactgaaagcgaatccgaaccgtcaggcaaaaggaacggttattgaagctgaactcgataaaggcagagggtcagttgcgacgttgctcgtacagactggaacactgcatgtcggtgatccgatcgtagtcggcaatacatttggccgtgtccgtgcaatggtcaacgacattggccgccgtgtgaaaactgccggcccatcaactccggttgaaattaccggtttgaatgatgtccctcaagcaggagaccaattccttgtctttaaggatgaaaaaacagctcgttctgtcggtgaagcccgtgcttcgaaacagcttgaagagcagcgcagcgataaagcgaagctcagtcttgatgatttattcgagcaaattaagcaaggtgatgtaaaagacatcaacctcatcgtaaaagctgacgttcaaggatctgctgaagctttaacggctgcgcttcaaaaaattgaagtagaaggcgttaaagtgaaaatcatccatacaggcgttggtgcgattactgaatctgacattatcttggcatctgcttccaatgcaattgttattgggtttaatgtgagaccggacggaaatgctaagagtacggctgaagctgaaaatgtagatattcgacttcaccgtatcatttacaaagtaatcgacgagattgaagctgccatgaaaggtatgcttgatcctgaatatgaagaaaaagtaattggtcaagtagaagtacgccaaacattcaaagtatctaaaatcggtacaattgccggcggatatgttactgaaggaaccattacgcgcgacagcggcctccgtttaattcgtgacggcgtcgtcatctttgaaggcgaagtagatgttctgaaacgctttaaagacgatgtgaaagaagtttcacaaggctatgaatgtggtattacaattaagaaatacaatgacattcgtgaaggtgacatcctagaagcgtttgtcatgcaagaaattgaaagaacgtgatcggatttgcggagtgtgaatgcatcatttatgatgcaggatcgctaaaagaaaagcgtgccgttctgaagcggattttaaccagggttcaaaacaagttcaatgtttcgatttcggagattggctatcaggacacctggcaaagaaccagcttcggaatcgccgctgtttcttcctctcgcgttcaaacagaaaaagaactgcagcgcgtcctagcgtttatcgattcttttcctgaaattgaacggacgatcactaggacagagtggttttaacttagaggtgattgaattgagtatgagagcaaaccgtgtcggcgagcagatgaaaaaagaactcggtgatattatcagccgcaagctgaaagacccgagaattggttttctgacagtaacggatgtacgtgtatcaggtgatttgcaaattgcaaaggtgtatatctcggttctcggtgacgagaaaaaacgggaagaagcgctgaaaggactggcaaaagcgaaaggatttatccgatccgaaatcggcagccgcatcagacttcgaaaaacgcctgaaattgaatttgagttcgatgaatcaatcgattacgggaatcggatcgaaacactgattcacgaattacattcagagaaaccatctgaataaaaaatgagaggataggcgtatatcgtctgtcctctttcttcgtttaaaagaaaaaagttaaaaaagaaggagtgaaaggcaaatggttaacggagttctccttttacataaacctgttggcatgacatcgcacgactgtgtcatgaagatccgaaagctgttaaaaacaaaaaaagtaggacatacaggaacgctcgatccggaagtgtcaggcgtgcttccgatttgtgtaggaagagcgacaaaaatagtcgaatacttaactgaaaaatctaaaacgtatgatgcagaaataacgcttggcttttcaaccacaacagaggatcaaaccggagaaacggtggaaacaaagcctgtcaatcacgacattgataaagcggatgtagaaaaggttttaaacagtttaaaggggaaacaagaacaaattccgcccatgtattccgctgtaaaagtaaacggcaaaaaattatacgaatacgcaagagcggggattgaagtagaacgtccgaaacgtatgataaccattgaagacattgccctgacgacagagattaaacatcatggagaaaccgcaagcttccggtttacagtgacttgctccaaagggacctatgtaaggacgctggcggtcatgatcggagaaaagctcggatatccggctcatatgtctcatttaatccgtacggcatccggagatttttctctcgacgaatgctttacttttgatgagctcgaagcacaggcccaatccggaaccgtggaagagcatacagttcctattgaacgtgcgctcaatcatttgccgaaatggatcataagtgatacattagctaagaaagtagaaaatggggctttgcttgagacgcccgagcagttttctgaaatgacaagtgaagaccgtatcgccgtctttactgaatccggaacctgtttggcgatctatttccctcatcctgcaaaaaaagggctgttaaagccggcaaaagtattgatgcaaaaaagcgaacaatagaaaaaaggtgaccgttctgtgaagacgatacatattacacatcctcatcatttaataaaagaggagcaggcaaaatcagtgatggcgttaggatattttgacggcgttcatctcgggcatcaaaaggtaatctgcacagcgaagcaaatagccgaagaaaaaggtctgacattggctgtgatgacctttcatccccatccttctcacgtgttgggcagagataaggaacctaaggatctgattacgcctcttgaagacaaaataaatcaaattgaacaattaggtacagaagttctgtatgtcgttaaatttaatgaagtgtttgcttctctttctcctaagcagtttatagaccagtatattatcggccttaatgtgcagcacgcagtggcaggctttgactttacgtacggcaaatacggcaagggaacaatgaagaccatgccggatgatttagacggaaaagctgggtgcacaatggtagaaaaattaacggagcaggataaaaaaatcagttcttcgtatatccgtaccgcgcttcaaaacggagatgttgaattggcgaatgtcttgcttggacaaccttattttattaaaggaattgtcattcatggtgataaaagagggcggaccatcgggtttccgacagcgaatgtcggtttaaataacagctatatcgtcccgcccacaggtgtatatgccgtaaaagcggaagtgaacggcgaagtttacaatggcgtttgcaatattggctataagccgacgttttatgaaaagcgccctgagcagccttccatcgaggtcaatctgtttgatttcgatcaagaggtatatggagccgctataaaaatcgaatggtacaaacggattcggagcgagcggaaattcaatggcatcaaagaattaacagagcaaattgagaaagataagcagcaagccatccgttatttcagcaatttacggaaataacttgcaacgcacgcaaattttattctaaaatatttgcatataggcacgatttttagtatgatagttttcgtagtcttaaaaccattgcttggcaatccgaagtcaccgacggttgctaggtaactggggctaaatatgatttggaggtgaaacaggatggcaattactcaagagcgtaaaaaccaactcatcaatgagttcaaaacacacgaatctgatactggatctccagaagttcagatcgctatcctaactgactcaattaacaacttgaacgagcatttacgtactcacaagaaagaccaccactcacgtcgcggtcttcttaaaatggtaggtaagcgtcgtaatcttcttacgtatctgcgtaataaagacgtaactcgttaccgtgagttaattaacaaactaggcttacgtcgataatcgtaaaaagcgggaggattcccgcttttttatcgtattaaagcgaaatttcttataacaaatcattgaaatccttttacatactactttgacattgatatgttcaattcatttcgttcataataggagtaattgattatttcacacaacgaagagaggagttcgtaattgtatgggacaagaaaaacatgtctttaccatagattgggccggaagaacgcttactgttgaaaccggccagcttgccaaacaggcaaatggtgctgtgatgatccgctacggtgatacagcagtacttagtacagcaaccgcttcaaaagaacctaaaccgcttgatttcttccctcttactgtaaactatgaagaaagattatatgcggtagggaaaattccgggcggatttattaaaagagaaggacgtccaagtgaaaaagcggttcttgccagccgtttaattgaccgtccgatccgtcctttgtttgccgatggattccgtaatgaagttcaagtcatcagcattgtcatgagtgttgaccaaaactgctcttcagaaatggctgccatgttcggttcatctcttgcactttctgtatcggatattccgtttgaaggaccgattgcaggggttactgtcggacgcattgatgatcaatttatcattaacccgacagtcgatcagcttgaaaaaagcgacatcaatcttgtcgttgccggcacgaaagatgcgattaacatggtagaagcgggagcggacgaagttcctgaggaaatcatgcttgaagccattatgttcggccatgaagaaattaaacgcctgattgcattccaagaagaaattgttgcagcagtcggcaaagagaaatctgaaattaagctctttgaaattgatgaagagcttaatgaaaaagtaaaagctttggcagaagaggatctgctgaaagccatccaagttcatgaaaagcatgcccgtgaagatgccattaacgaagtgaagaacgcagttgtggcaaaattcgaggatgaagaacatgatgaagacacaatcaagcaagtgaagcagattttatccaagctggtgaaaaatgaagttcgccgcctgattactgaagagaaagtaagaccggacggccgcggtgtcgatcaaatccgcccgctctcttcagaggttggcctcttgccaagaacgcacggttcaggtctatttacaaggggacaaactcaggccctcagcgtatgtacgctaggtgctctgggagatgtgcaaatccttgacggcttaggtgtcgaagagtcgaaacggtttatgcatcattacaacttcccgcaattcagcgttggggaaacaggaccgatgcgcggaccgggacgtcgtgaaatcggacacggagcactgggtgagcgtgcgcttgagccagttattccgtctgaaaaagacttcccttatactgtccgtcttgtttcagaagtgcttgaatcaaacggttctacatctcaagcaagcatttgcgcaagcacacttgcaatgatggatgccggtgtaccgattaaagcgccagttgctggtattgcgatgggtcttgtcaaatcaggcgaacattacactgtcttgactgacatccaaggcatggaagacgcgctcggagatatggactttaaagtagcgggaactgaaaaaggcgtaacggccctgcaaatggacattaaaattgaaggcctttccagagagattcttgaagaagcgcttcagcaggcgaaaaagggcagaatggaaatcctcaacagcatgcttgcaacattaagcgaatcaagaaaagagctttctcgatatgcgcctaagatcttaacaatgaccattaatcctgataaaatccgcgatgtcatcggaccaagcggaaaacaaatcaataagatcatcgaagaaaccggtgttaaaattgatattgagcaggacggcacaatctttatttcctctacagatgaaagcggcaaccaaaaagcgaaaaaaatcatcgaagaccttgttagagaggttgaagtcggccaactttacctaggtaaagtgaaacggattgaaaaattcggggctttcgttgaaattttcagcggaaaagacggcttggtgcacatttcagagcttgcgcttgaacgcgtagggaaagttgaagatgttgtaaaaatcggagacgagattcttgtcaaagtcactgaaattgataaacaaggacgagtgaatttatcccgcaaagcggtgctccgtgaagagaaagaaaaagaagaacaacaatcttaaatgaaaacataaaaggagcctgggagacccggcttctttattttgaagcttttcaaaagcaggcgggttctaccttgtccttctccttcataatgtgaggtgagggggacagaacatgtacaaaaaatttgtaccgtttgccgtttttttatttcttttttttgtctcatttgagatgatggaaaatccgcatgcacttgattatataggggcaatgaaaaaagatacggtgactgtcacggcgtcaaaagacccgttatatgaagaattgcttcaaaaagcgccggagtacgaagttaagccccagaatgcaagaattgataaagtgtggaaaagcattcccggctacaatggattaaaggtcaatattgaacaatcatataaaaaaatgaaaaagcatggtgagtttcgggaaaaagatttggtgtacagtcaagtaaaaccaagtgttcatcttgagtcacttcagcctgagcctatttataaaggaaatcctgacaaaccgatggtggcttttttaatcaatgtggcatggggaaatgagtatttggaaaaaatgctccctattctgcaaaagcaccaggttaaagctacgttctttttagaaggcaattgggtgagaaacaatgtacagctcgctaagaagattgcaaaagacggacatgaaatcggaaatcattcatacaatcatccggatatgagcaaactgactacaggaagaatttccgagcagctcgacaagactaatgaacaaatagaacaaacgatcggtgttaagccaaagtggttcgctccgccaagcggaagtttcagaaaagcggttatcgacattgcagcagagaaacagatgggaacagtcatgtggacagttgatacaatcgattggcaaaagccggctccgtctgtacttcagacgagagtgttaagcaagatacataatggtgccatgattttaatgcatccgactgaccctacggcggaaagtcttgaagcgctgattacacagataaaagacaaaggatatgcgcttggaacagtcactgaactaatggatgaaacaagactattgaagtaacagatgaaggcagcttgtctttgaataggaggaacaaatttgattaaacgatatacgtgtcaaaatggtgtaagaattgtgctggaaaataacccgacagtccgttctgttgcgatcggcgtatggatcggcacaggttcgagacatgaaacgccggagataaacggaatttctcactttttagagcacatgttctttaaagggacgagcacaaaatctgcacgcgagatagcagaatcttttgatcgtattggcggccaggtcaatgcgtttacttcaaaggaatatacctgctactatgcaaaggtgcttgacgagcatgcgaattacgcgctggacgtattagcagatatgttctttcattcaacgtttgatgaaaacgagctgaaaaaagagaaaaatgtagtatatgaagaaattaaaatgtatgaagatgcgccggacgacattgtacatgatttattgagcaaagccacttacggcaatcattctttaggctacccaattctaggcacggaagaaacgcttgcttcctttaacggtgactctctcagacaatacatgcatgattattatacgccggaccgagtggtgatttcggtagcgggcaatatatctgacagttttatcaaagatgtagaaaaatggttcgggtcatacgaggcgaaaggtaaagcgacaggccttgagaagcctgagttccacacggaaaaactgacgagaaaaaaagaaacagagcaggctcatttgtgccttggatttaaaggcttagaggttggccatgaacgtatttatgatttaatcgtcctcaacaatgtgctcggaggcagcatgagcagccggctgttccaagatgtgcgtgaagataaaggacttgcttattctgtttacagctatcacagctcatatgaggacagcggaatgctaacgatttacggcggaacgggtgcaaatcagcttcagcagctgtcggaaacaattcaagaaacccttgccacattaaaacgtgacggcattacctcgaaagaactggaaaacagcaaagagcaaatgaagggaagcttaatgctgagcttagaaagcacaaacagcaaaatgagccgaaacggaaaaaatgaactgctgctcggcaaacataaaacattagatgaaatcatcaatgaattaaacgccgtgaacttagagcgtgttaacggccttgccagacaattgtttaccgaagactatgcattagcacttatcagcccttccggcaatatgccgtcttaaaaaggaaagcctgctccataatggagcaggcattttttaatccctttcatcatacatagtacaagggggtgacagacatgcggctcagtgaattatcaggaaaggaaattgtagacatcaaaagagctgaacggctcggagtgctcggccagaccgatttggaaatcaatgaacaggatggacagattacagcactcctcattcccacagttaagtggtttggtttgagaaagcaaggtcatgacattcgtgtcccatggcaccatattcaaaagatcggttcagatatgattatattagatgtacctgaggaaatgcctcctcgacaagagtaaatagcccaattgactgtgaagcgggctctaaagaaaacatctgaaacatcggctgccggagccgatgtttttttatatggaaaaagcgcatcttttatattcaccagtattttcttttgatcataagatgaaggggagcttaacaactagagatccagtatatacaaagaaggtgaacgtttagaatgttaaccggattgaaaattgcagttatcggcggtgacgcaagacagctcgaaattataagaaagctcactgaacagcaggctgacatctatcttgtcggttttgaccaattggatcacggttttaccggggcagtaaaatgcaatattgatgaaattccttttcagcaaatagacagcatcattcttccagtatccgcgacaacaggagaaggtgtcgtatcaactgtattttctaatgaagaagttgtgttaaaacaggaccatctcgacagaacgcctgcacattgtgtcattttctcaggcatttctaacgtctatttagaaaacattgcagctcagacaaaaagaaaacttgttaaactgtttgagcgggatgacattgcgatatacaactctattccgacagtagaaggaacgatcatgctggctattcagcacacggattatacgatacacggatcacaggtggccgttctcggtctggggcgcaccgggatgacgattgcccgtacatttgccgcgctcggggcgaatgtaaaagtgggggcaagaagttcagcgcatctggcacgtatcactgaaatggggctcgttccttttcataccgatgagctgaaagagcatgtaaaagatatagatatttgcattaataccataccgagtatgattttaaatcaaacggtactttctagcatgacaccaaaaaccttaatattggatctggcctcacgtcccgggggaacggattttaaatatgccgagaaacaagggattaaagcacttcttgctcccgggcttccagggattgtcgctcctaaaacagctgggcaaatccttgcaaacgtcttgagcaagcttttggctgaaatacaagctgaggaggggaaataaggatgtcgtcactaaaaggaaaaagaatcgggtttgggctgaccgggtcgcattgcacatatgaagcggttttcccgcaaattgaggcgttggtcaatgaaggagctgaagtccgtccggttgtcacatttaatgtaaaatccacaaatacccgatttggagagggcgcagaatgggttaaaaaaattgaagacctgactggatatgaggccattgattcgattgtaaaggcagaacctcttgggccgaagctgccccttgactgcatggtcattgcgcctttaacaggcaattcaatgagcaagctggcaaatgccatgacggacagcccggtgctgatggcggcaaaagcgacaatccggaacaatcggcctgtcgttctgggtatctcgacaaatgatgctcttggtttaaacggaacaaatttaatgaggctcatgtcaacaaaaaatatcttttttattccattcgggcaagatgatccatttaaaaaaccgaattcaatggtagccaaaatggatctgctaccgcaaacgattgaaaaggcactcatgcaccagcagcttcagccgattctagttgagaattatcagggaaatgactaaatttacagaaaatctttcccaaactaaaaaattcggtcatcacccgcatattctatggtaaaataaaacgtaaaatcatagtcaaatcaattcaatgaagctgattggcggaaggagttttacagatgggaagaggtttacacgtagctgttgtcggagcgacaggggctgtgggacaacaaatgcttaaaacacttgaagacagaaactttgaaatggacacacttacattgctatcttcaaaacgctctgcggggacaaaagtcacgtttaaaggccaagaactgactgttcaggaagcttctcctgagagctttgaaggggtaaatattgctttgttcagcgccggcggaagcgtatcacaagcattggcaccagaagctgtaaaacgcggcgctattgttatagataatacgagcgcgttccgcatggatgaaaatacaccgcttgttgtgccagaagtgaatgaggcagacttgcatgaacacaacggcattattgccaatccaaactgctctacaatccaaatggttgcggcacttgaaccgatccgcaaagcatatggcttaaacaaggtcatcgtatcaacttaccaggcagtatcaggagcgggtaatgaagctgtaaaagagctttacagccaaacacaggcgattttaaataaagaagaaatagagcctgagatcatgcctgtaaaaggtgacaaaaaacactatcaaatcgccttcaacgcgattccgcaaatcgataaattccaagataacggctatacgtttgaggaaatgaaaatgataaatgaaacgaaaaaaatcatgcacatgcctgaccttcaagttgcggctacatgtgtgagactgccaatccaaactgggcactcagagtccgtctacattgaggtagaccgtgatgacgctacagttgaagatattaaaaatctattgaaagaagctccgggcgtgacacttcaggatgatccaagccagcagctttatccgatgcctgctgatgctgtcggcaaaaacgatgtgtttgtgggccgcattcgcaaagacttggacagagcaaacggttttcatttatgggttgtttctgataacctattaaaaggcgcggcatggaactctgttcaaattgcagaaagcctgaaaaaactaaacctcgtataaaagagagaattttctaaagacgaatagaagagagtaaggcgctatcagcctgctctcttctgttacgtccgaataatttggagtgaaaacagtgaagataattgttcaaaagttcggcggaacatcagtaaaagatgataaaggccgcaaactggctttagggcatattaaagaagcaatcagtgaaggatataaggttgtcgttgtcgtttcagcgatgggccgaaaaggagacccgtatgcaacagattctttgctcgggctgctttacggcgatcagtcagcgatttctcctagggaacaggatttgcttttatcttgcggagagactatttcctctgtcgtctttacaagcatgctgcttgataacggtgtgaaagcagctgcgctgacaggggctcaggctggctttttaacgaatgatcagcataccaatgcaaaaatcattgaaatgaaaccggagcgtttattcagtgtgctcgccaatcatgatgcggtagtcgtcgcaggcttccagggcgcaactgaaaagggtgatacaacaacaatcggcagagggggcagcgatacgtctgcagccgcactcggagcagctgttgatgcggaatacatcgatattttcaccgatgtagaaggcgtgatgactgctgacccaagagtggtggaaaatgcaaaaccgcttcctgttgtgacgtatacagaaatctgcaacctggcgtatcagggggccaaggtcattcatccgcgtgctgtggaaatcgcaatgcaggccaaggttccgatccgcgtccgttcgacttattcgaatgataaaggtacattggtgacatcacatcactcttccaaggtcggcagtgatgtttttgaaaggctgattacgggaatcgcccatgtcaaagatgtcacgcagttcaaagtgcctgcgaaaatcggccagtataacgttcagactgaagtgttcaaggctatggcaaacgctggaatcagtgtcgatttctttaacattacacctagtgaaatcgtctatacggtagccggaaataaaacagaaacagctcagcgtattttaatggatatgggctatgatccaatggtgacgagaaactgcgcgaaggtatcggcggtcggcgcgggcattatgggtgttcccggtgttacgtccaaaattgtatcggctctttcagaaaaagaaattccgatccttcagtcggctgacagccatacgacgatatgggtgctcgtccatgaagcggatatggttcctgctgtaaacgctttgcatgaagtgtttgaactttcgaagtaaatgtgattgaatcatgatgaggtgaataaaatgaatttcggaaatgtgtctacagcgatgattacaccctttgacaataaagggaacgtagactttcaaaaactgtctacactgattgattacttgttgaaaaacggaacggattctttagtagtagcgggaacaactggagaatctccgaccctttcaactgaagaaaaaattgcgctttttgaatatacggtaaaagaagtaaacggacgggtgcccgttatcgctggtactggaagcaacaacacgaaagattccattaagctgacaaaaaaagctgaggaagcgggcgtggacgctgttatgcttgttaccccgtattacaataaaccttctcaagaaggaatgtaccagcattttaaagcaattgcggcagagacatctcttccggttatgctctataatgttcctggccgtacggttgcttctcttgctcctgaaacgacgatccgtttggcggcggacattccgaatgtggttgcgattaaagaagcaagcggagacctcgaagcgattacaaaaattattgctgaaacaccggaagacttctatgtctattcaggggatgacgctctgacgcttcctattctttcagttggaggaagaggagttgtatcagtggcgagccatattgcaggctctgatatgcagcaaatgatcaaaaattatacgaatgggcaaacagctaatgcggcactgatccatcagaaactgctgccgattatgaaggaactgtttaaagcgcctaatcctgctccagtcaaaacagcgcttcagctgagaggtcttgatgtcggttctgtgcgtctgcctctagtcccgttaactgaggatgaacgtctgagcttaagcagcacgatcagcgaactgtaagaaaatttcatacagtgaaacaaacgcggtcattctcacattcagctgagtttgaccgtttcttttacatattggttttccctaaaccttctgctttatcttgttttctaaatttactttcagttataataggaacaagtgatgatggacgggtatgagactaggaggatatagattttgaaaaagaaaaatacagaaaacgttagaattatcgcccttggcggtgtcggagagattgggaagaacctttatgtcattgaaattgactcagacatatttgtcgttgatgccggccttatgcatccagaaaacgaaatgctcggtattgatgtagtgattcctgacatatcatatttgattgaacgggctgaccgcgtcaaggcaatctttttaacgcacgggcacgatgaaaatatcggcggcgttttttacttattaaacaagctgtccgttccagtgtacggaacaaaactgacgcttgcactgttaagagagaaattaaaacaatacggacataaccgaaaaactgatttaagagaaattcactcaaaatctgtcattacatttgaatcaacaaaagtatcgttctttagaacgattcacagcattcctgattctgtaggtgtgagctttaaaacatcacttggatctattgtatgcacgggagacttcaaatttgaccaaacacctgcacttaatcagacgtgcgacattggcgagatcgccaagatcggcaatagcggcgtgctcgctctgctttctgacagtgcaaatgcggaacggccgggttacaccccttcggaagcggctgtcagcggagaaatttcggatgcgctgtataattcacagaaccgggtgattattgctgttttcgcatccaatattaaccggattcagcaagtcattcatgcagcggctcaaaatggcagaaagattgccgtagccggaaaaaatcttcaatctgtcctgcagctggcgagaaagttaggatacattgaagcagatgatgaattgtttatttctgtacaggatgtcaaaaaatatccgaagcgcgaagtggccattattacagccggaagccaaggtgaaccattagctgctttgacaagaatggcaaacaaagctcacaaacagctgaacattgaagaaggggatacggtggtcattgcgtcaactccgattcccgggcaggaactcatttactctaaaacagtagatcttcttgcgagagccggtgcacaagtcatctttgcccaaaagcgtgttcatgtatcaggccacggctcacaagaagagttaaagctgatgatcaacctgcttaaaccaaaatatttgattcctgtaaacggcgaatacagaatgcaaaaagctcattcaaaaatcgctgaagaaaccggcatgaagcgcagtgacatcttcttaattgaaaaaggcgacgtcgttgaattccgcggccaaaacgtaaaaattggggataaagttccttacggcaatattttaattgatggtttaggtgtcggtgatatcggcaatatcgtattgagagaccgccgcttgctttcacaggacggaattttaatcgttgtcattacacttgataaacaaaagaaacatcttgtatcaggaccagaaattatcactcgcggctttgtttatgtaagagagtctgaaggtcttatcgtacaggctactgagcttgtccggtccatcgtgacagaagcgactgaaacatcaaatgtcgaatggtcaacgttgaagcaggcaatgcgggatgctttgaaccaattcctttatgaaaaaacgaaacgtaaaccgatgatcatcccaattattatggaagtataatgactgactaaagaccggagctgctccggtctttattttttgtccttcaagccgggattgaatgaagtatctttgttcataatacaaagagaaactcggaaaggatgaaagcgagatggatcatcgtatggaaaacacagaagaagagcgtcctgaaaaaaatgatgcgaaggacagcattatgaataaaatacagcagcttggtgaaacgacgcttccgcagctgccccaagatacaaatattcattgtctgaccattatcggacaaattgaaggccatgttcagcttcctccgcaaaacaaaacaacaaaatatgaacatgtcatcccgcagattgtggcaattgaacaaaatcctaaaattgaaggcttgctgatcatattaaatactgtcggaggagatgttgaagctggtcttgcaatagcggaaatgcttgcatctttatcgaaaccgaccgtttctatcgtgcttggcgggggcattcaatcggcgttccgattgctgtatcctgtgattacagctatatcgccgaaacagcaacgatgacgattcatccagttaggctcaccgggctggtcatcggggtaccgcaaacgtttgaatacctggataagatgcaagaaagagttgttaaatttgtgacaagccattccaatataaccgaagagaaatttaaagagctaatgttttcaaaaggaaacttaacacgggatatcggaacaaatgtggtcggtaaggacgcagttaaatacggattgatcgatcacgcaggcggtgtcggacaggcaatcaataaactgaatgagctcatcgacgaagcaaggaaagaagaaggacggatgattcaatgattctttataccgtgatgccgcaggaaattgtgtttgcagaacagaaccaagagacaagcgcacatgagcaaattgaatataaaggtgtaccgcttctagtcgaaatgaaagggaatgaagcggaagtcattcaaatcatgagcaccaatccaatgcattttctgcatccggacatttcaccgggacaaaagctgaaattaaacgtataagaatccaaccctttttaaagggcaaaatatgctataataggggaatcctacagaaaaaacgcagcctgtaaacggctgctttcttcattatgtatgaacttacattttttaacgcagtaaggtgatgagtatggcaaagaaaaaacgaaaattaagaaaaaaacaggcgaaacagctcaatataaaatacgagctcaacggattgctgtgtatagccatttcaattatcgcaatcttgcagctgggggtagtcgggcaaacgtttatctatttgttccgcttttttgctggagagtggtttattttatgcttgttaggtttattggtgttaggagtctcactgttttggaagaaaaaaaccccaagccttttaacgagacgaaaggccgggttgtactgtattatcgcaagtatattgctgctttctcacgtgcagctatttaaaaatttgacgcacaaagggtctattgagtctgcaagcgtggtgcgcaatacgtgggaattgtttttaatggacatgaatggcagctctgcttcacctgatttaggcggaggaatgatcggtgcgctgctgtttgcggcttcacactttttgtttgcgtcgactggttctcagatcatggcaattgtcatgattttgatcggaatgattttagtaacaggacgctcgctacaagaaacgctaaaaaagtggatgagcccgattggacgttttataaaagaacaatggttagcatttattgatgatatgaaatccttcaaatcaaatatgcagtcatcgaaaaaaacgaaagcgccgagcaaaaaacaaaaaccggcccgcaaaaaacagcaaatggaaccggagcctcctgatgaagagggggattatgaaacagtatcgcctcttattcattcagagccgattatctcaagcttttctgatcgtaatgaagaggaagagtctccagttatagaaaagcgcgccgaacctgtgtcgaagccgcttcaggacatccaaccggagacaggtgatcatgaaactgtttctgctcctcctatgacctttacagagctcgaaaataaggattacgagatgccgtcactggatttgctggcagatccgaagcataccggccagcaggctgataaaaagaatatttatgaaaatgcgagaaagcttgaacgcacattccaaagctttggcgtaaaggcgaaagtcacacaggttcatctcggaccggccgtaacaaaatatgaagtatatcctgatgtcggagtgaaggttagcaaaattgtcaatttaagcgatgatttagcgcttgcgcttgctgcgaaggatatcaggatcgaagcgcctataccaggcaaatcagcaatcggaattgaagttccaaacgcagaagtggcaatggtttcgctgaaggaagtgctggagtctaaattgaatgacagaccggatgcgaagctgttaattggactcggccgcaatatttcaggtgaagctgtattggctgagttaaacaagatgccccaccttttggtcgcaggcgcaaccggtagcgggaaaagtgtctgtgtcaacggcattattacaagtattttaatgcgcgcgaaaccgcatgaagtgaaaatgatgatgatcgatcctaaaatggtagagctcaatgtctacaatgggattccgcatttgcttgctccggttgtaaccgatccgaaaaaagcgtcgcaggctttgaaaaaggttgtcaatgaaatggagcggcggtacgaattattttctcatacgggtacaagaaatattgaaggatacaatgattatataaaacgcgccaacaatgaagaaggagcgaaacagccagagctgccctatattgttgtcattgtggacgagcttgccgatctcatgatggtcgcttcatccgatgtggaagattcgattacgagattgtcccaaatggcgcgggctgccggcatccatcttattattgcgacacagcggccatcggtggatgttatcacaggggtgatcaaagcgaacattccgtcacgaatcgcgttcagcgtatcttcacagacggattcaaggaccattcttgacatgggtggcgctgagaagcttcttggccgcggcgatatgctgtttttacctgtaggggctaacaaacctgtccgtgtgcagggagcatttttgtcggatgacgaagtggagaaggtcgtcgaccatgtgattacgcagcaaaaagcgcaatatcaagaagaaatgatccctgaggagacaacggaaactcattccgaggttactgatgaactttatgatgaagctgttgaattaattgtcggcatgcagacggcatctgtttcaatgctgcaaagaagattcagaatcggctatacgagagcggcgcgcctgattgacgcaatggaggaacgcggtgttgtcggaccgtatgaaggcagcaaacctagggaagtattattatcaaaagagaaatatgatgagctctcttcttaatgaagggagttccgctttctatagtcgtcaataataacattatgtaaactgatcacctttctatttattttttcgacaaaacatgatatagttgtcccaattgttcaataatttttatcgaaagtggtttacggaggggaaacatgtctacaaaagctgataatcggcacttgtatttgaaagtaattgaacgaattaaagaggatataaaaaatgggatctacactgagaaggaaaagctgccttctgaatttgagctttccaaaaagcttggtgtcagcagagcgacgctaagagaagccttgcggatactggaagaagagcatgtgattatcagaaggcatggtgtaggcacttttgtccattctaagccgttatttctttcgggcattgaacagctaaacagtgtaacgaagatgatagaacaggcgaatatgacccctggcacgatttttctatcatcacaagtgcttatgccgtctgaagatgatacgaagagatttcatttggcagaagggcaagaacttttttaccttgaacgagtcaggacagctgacggacagccgattgtgtattgtatagacaaaattccgatgaatattttgccgaattctttttctcatcagcaagaatctatgtttgacctgcttgagaaaaattcaggctccgtaatcagctatgcagtaactgatatagaaccgatcggctatcacgataccatttctcccgtacttgaatgcgatccggaaacagctcttttgctgttaaaacaaacccattacgatcagcacgataaaccggtgctttattctttaaattattttagagcggataaattcagatttcatgttttgcgtaaacgattctaaaaacggacgcctgtatgtgtctgtttttttatttgcactgattcatgtttctttgtacatactttcattccggttaacgcaatatataagggatgacaagaaagtgaatgggtgaaaatgttgagagagaaaaatggaatgaaaaatattattgcattgtcttccgtcccgcttgtgatgacactcgggaactccatgctgattcctgttcttccgatgatggagaaaaagctgtctgtgacttcatttcaagtgtctttaatcattactgtatactcagtagtagcaattatttgcattccgattgccggatatttgtcggatcgtttcgggagaaaaaaaatattgcttccatgcctcctcattgcaggattgggggagccgtagctgcttttgcctcgacctatatgaaaaatccttatgctatgatcttggcggggcgggttcttcaaggcattggttctgcaggtgccgctccgatcgtcatgccgtttatcggcgacttgtttaaaggagacgatgaaaaggtcagcgctggtcttggcgatattgaaaccgccaacacgtcagggaaggtactgagtcccatacttggagccttgctggcttcttggtattggtttgtaccgttttggtttattccgtttttctgtttgatcagctttttgctcgtattgtttttggtggccaagcctgaagaagatgaagatgcgcctgctgtttctgagtttattaagagtgtgaagaaaatctttaaacaagatggtcgttggctttatacggtcttcattatcgggtgcgtcattatgtttttgttatttggcgtattattttatttatcagatacgctggagaacaagtatgccattgacggagtagctaaaggcggattactggcaatcccacttttgtttttgtcaaccagttcttttatagctggcaaaaagatcggtaaagataaaggccgaatgaaattttgcgttgttacaggaatgattctgttaaccctttcgtttattgccttgtggtggaaccacagtttttattttttatttgtctttttaagctttggcgggattgggattggaatggctcttcctgctttagatgcactgataaccgaagggattgaaagtgaacaatgcggaaccatttcctccttctacaatagcatgcgctttataggagtagctctcggtccacctgtttttgctgcattaatgtctaatgcaaactggattattttcatactctcggcgttttgcagcatcgtttctttatttttagtgctctttactgtagatgctaaaaaaagtgaagaagaagaaaaaaacttagggacggtctagccagccgtctttttttgcgctttcttgcacagtttacaactgtacctatacagcattcggaggttattgtttccttataaatcctacagttgctataattacatgaaagagtgtttctgcgaatgctgaaaattggtcataatacatactaattaagaaatgaacgaaggaggttccatatgtcatatgttaatgaactcaaatcaaagcacggcggtttaaccgcacacattgtagaaacagaaaaattcaaaaccgtctcgcttatttttaagatgctggcaccgctgacaaaggatcaagtcaccaaaagagcgctgcttccgcatgtgcttcttcgcggaacgaaaagccatccgaaaaccgcagaattgcgttcatacctggatgagctgtacggcacgtcagtatcggctgatcttacgaaaaaaggagagcggcacgtcattacgttcaggcttgaaatcccgaatgaaaaatatttaaaagaccaaacgccgctacttgagaaagggctccagcttcttgcagaaatcgtcttttcacctgctttagagggagacgcttttcagtcacaatatgtggctcaagaaaaacggacgcttaagcaaagaatccaagccgtctatgatgataaaatgcgctattcgaatttaaggctgatacaggaaatgtgcaaaaatgagccttatgcgcttcatgtcaatggtgaaatcgacgatgtcgatgacattacggcagagcaattatacgaaacataccaaagcgctatccaaaaagaccagcttgatctatatgttgttggcgatgtggacagtaaccaggtacaatcggcaatcgataagtatttcaaaacagaagagcgcactcttggcacgattgaaaacaatcacgctgatgaaaaagttcagccaaaagaagtaattgatgaagaggatgtcaagcaaggaaagctgaatatcggctaccgcaccagtatcacttatacagatcaggattatcctgctttacaagtgtttaacggattgttcggcggattctctcattctaaacttttcattaatgttcgggaaaaagccagtcttgcttactacgcggcttcccgtatagaaagttttaaaggcttgttaatggtgatgtcaggcattgaagtgaaaaattttgaacaggctgtttcgattattgctgagcaattccaggcaatgaaaaacggcgatttcagtgagcaggatatagcacagacaaaggccgtcattcgaaatcaagtgctggaaacgattgatacagcatacggtttatctgaatttttatatcagcaggccgctgctcaagtcgagattcctatcgaagactttcttgccaatattgagaatgtcacaaaagaggatatcattaaagccggcgaaaagattcagcttgatacgacttatttcttaaaagggacggagggtgcatcttgatcaaaccaatcgaatatgaacagcttcaggagacgctgtatcatgaaaaaatgtccaacggccttgatgtttacgttttgccgaaaaaaggcttcaacaagacatatgcggtctttacaacaaagtacggctcgatagataaccggtttgtccctttaggtaaaaatgagatggttcacgtgccggacgggattgctcactttcttgagcacaagctgtttgaaaaagcggacggagacgtttttcaagatttcagcaaacagggggcttctgccaatgcgtttacgtcatttacaagaacagcttaccttttctcaagcacatcaaatgttgaacgcaatttagagacgcttatcgatttcgtacaggacccatattttactgaaaaaacggttgaaaaggaaaaagggattatcgggcaggagattaatatgtacgacgataaccctgattggaggctttacttcggggtcattgaaaacatgtacaaagagcatcctgtcagaattgacatagcgggaacagtggaaagcatttcacatattacaaaagaccttctttatgaatgctatgaaacgttttatcacccgagtaacatgctccttttcattgtcggacctgtagatcctgaagcgattattactcaggtaagagaaaaccaggagaaaaagccgtataccgatcagccggagatcaaacgggaagaagtgaaagagcaagaagcggttttccgaaaagaaaaagagatcaaaatgaacgtgcagggaccgaaatgccttgtcgggctgaaatccaaaaagccgtttaaattaggcaaagagctcttaaagcatgaactttcaatgaacttattgcttgaagctctttttggcaaaagctctgcccagtatgaatcactttatgaaaaaggatatattgacgaaacgttcagctttgattttactgctgaatatgggttcggttttgcggcgatcggcggagatacgcctgagcctgatcaattggctgaagacatttcaagcatgcttttgcgcgccggtgaactgattactgctgaaaagattgaacttgccagaaagaaaaagatcggcacattcttaaaagcgctgaattcccctgaatacatcgccaatcaatttacccgttatgcgttcttggatatgagcctgtttgacgttgtaaccgtactcgagcagattaccctcgaggatgtccagaacgtaatacaagaggaaatttctgcagacagactgactgtctgcaaggttgttcctaaatcataaacaaaacatccctccagtgtgaggggtgtttttctgcggaaagaaggaaagaggatgaacaaaacagcactaatcaccggagcaagcggcgacattggcaaaagcatcagcgaaacccttgcagctagagggtacaatctgctgctgcattacaatacaaatcaaaacgcggcagcggagcttgctgaaaaactaagtgagatgtttggcgtaaatgctgagatattacaagctgatctgtccgcgcaagatggggcagataagctgacaagttcaattgttcagccgattgatgcgattgttttaaacagcggaagaagccattttgggctgattacggatgtagataacgcaacggtccaggaaatggttcagcttcatgtggcgagtccgtatatgctgacgagaaaccttctgccaggcatgattcggaataaatcgggagcgattgtggctgtcagctcgatttggggagagactggagcatcctgtgaagtgctgtacagcatggcaaaaggagctcagcattcgtttgtaaaaggattggctaaggagctggcgccaagcggaatcagagtaaacgccgtagcgccgggcgcagttgatacaaatatgatgaatcaattttccccggctgaaaaagaagagatcgctgatgagattccgatcggccggctggcccggccgcaagaaattgcggatgcaacagcttttctcctgtctgaaaaagcgtcatatatcaccggccaaattctgtcggtcaatggcggctggcactgctgatccgaaaatattcggtgtatagtttcttttgcgaaggacacaataatcttgtaacttcacatgaaatggaggaaacaagcatgtcagtattagaaaactgggatagctggaaaaacttccttggcgaccgtctgaactatgcgcaagataaaggtatgagccaggatacgattacagatcttgcgacagaaatcggcagctacttggctaatgaagtggaatctaagaacgagcaggaaaaagtgctggcagatctttggagtgtagcatcaaaagatgaacagcacgccattgccaatatgatggttaagcttgttgaaaataacagcactcactaggaagagaggggatttttcctctcttttttatgttttcctcatcacagcaacattcttctttctaattagagaaaaatgctttatgataaaggaaggtaaaattttgccacaatgaagggggtatatcatttggcaaagctcgaatggtattttgaatatgaaattcaagtgaaccgccccggactgctcggggatatttcgtctcttcttgggatgctttctatcaacatcgtaacgataaacggcgtcgatctttccagaaggggaatgctcctcaggtgccgccatatagatcaaattaaacgattagaatcaatcttaaaaacgatggaaacaattaaagtaacgaagcttagagaaccgaggcttcgcgaccgtcttgccgtacgccacggccgttatattcaacgggatgccgatgacaagaaaacgttccgctttgaacgggacgagcttggcttattagtcgattttatggccgaattgttcaaaaaagaaggccataaattaatcggaatcagaggtatgccgcgtgtcgggaaaacggaatcgattgtagcctctagtgtgtgtgccagcaaaaggtggctgtttgtgtcatcaaccttgctgaagcagacgataagaagccagctgattgccgatgaatacagcactgaaaatgtctttatcgttgacggaattgtgtcaacacgaagaggatcggaacgccatctccagctggtccgagaaatcatgcggcttccggcaacaaaagtggtggagcatccggacatattcgttcaaaatacagagtatacactagatgactttgattatattattgaactgagaaatgaccctgatgaggttattacatatgaacatgccgaggaaccccaaatgtttgatcaatccgggttttcaagctttgatttttaaaattggaaggtgtttgttgtgactgaactaggaatccggctcaaagaagccagagaggaaaaagcaatgtcattggatgatctccaagcggcaacaaagattcaaaaaaggtatttaaccgccttggaggaagggaactatgacattattccggggaagttttatgttcgggcattcatcaagcaatatgcagaagccgttgggcttgatgcggatcaactgtttgaggagcataaaaaagatatccctaatacgtatcatgacgatgtgtctgaaaagatctccggcatgaatcttcaaaaggaaatgccaaagccagcatctaaggcgctggagctgctgccaacgatacttgttattctcggcgtgattgtcgtgattgccattgtgtacgcgatcattcagtttgcgaatcacaaaagcagtgatgatcacaatgcggcatcagaaaaagcaattacgcaaagtgagagcaagtacgaaatccctaaagattcaacgctgaaagagaatcaaaagaacagctctgaaaaagagacagacactaaaaaagaaacgaaagaaaacgaaaataagaaagaagaaaatgacagtgataagctggagattaaagctgctggcactgaaggatcgttaacgacttatgaagtatccggcgctgataaaatcgagctggaactgaaggcatcagacagctcctggattcgagtgcgcgatgaaaacagcagctctttaaaagaaggaacgctgaaaaaagacgaaacctataaaaaagacataactgatcagaaacaagttgatatccgcactggatatgcacctaatctgaaaataaaaatcaacggtaaggttctttcatatgaacttgatccgaaaaaagtgatggcacaaaccataaagattgtaaataaaaaggaagaaaagtcatcttaattaccagatgacttttcttcacgtccgagtatgaaattggaggggctttatgtttaacttaccaaataaaatcacactagctagaatcgcattaatcccaatcttcatgattatcatgctggcgccgtttgactggggcaggctcgaagttggagacgaatcgatcccggtcgcacatttggcggggccattctatttattattgcatctacaacagactgggtggacgggtattatgcccgaaaattgaatctcgtaacaaacttcgggaaatttcttgatccgcttgcggacaaactgctcgtatccgcagcgttaattatccttgttcaatttgatctcgctccagcttggatggtcattgtgattatcagcagggagtttgccgtgacaggtttaaggcttgtcttagccggaacaggagaagtcgtagctgctaacatgcttggtaaaatcaaaacctgggcacagattattgcggtatccgcattgcttcttcataatcttccatttgaacttgtgtcattcccgtttgcagacttggcgctgtgggtagccgtcttctttactgtcgtctcaggctgggaatatttctctaaaaattgggaagcgttaaaaacatctaactaagaaagaaggacttcgtcatggaatttccaaaaaaagcagaaataattgcagtcggttcagagttgctgcttggtcaaatcgccaatacaaatgctcaatttatcagcaaacagctcgctgaaatcggggtcaacgtattttatcatacagcggtcggagataacccggagcggctgaagcaggtcatcagcattgctgaagaacgctctgacttcattattttttcaggagggcttggacccacaaaagatgatctgacgaaagaaacgattgcaaatacgctgggacgtccgcttgtgttaaatgatgaggcattccaatccattgaggactatttcaaacgaacaaaacgcacgatgtcacctaataaccgaaaacaggcgcttgtgatcgaaggctctgacgtgctggcgaatcactttggaatggccccgggaatgctcacagagcatgaatcgcgctattatatgcttcttcctggaccgccgagcgaattgcgtccaatgtttgaaaacgaggcaaagcctcttctgctgaaaaagatgggttcaaatgaaaaaattgtgtcaaccgttcttcgctttttcggtatcggtgaatctcagcttgaagccgatttggaagatattattgatgcacaaaccaatccgacaattgcgcctttggcggctgatggagaggtgactctgcgtctgacagccaaacacgccgatgaaaaggaaacagagcgtctgttaaaagaaacagaggccgttatcttagagcgtgtcggtgaatttttctatggttacgatgatacttctcttgtaaaagagctatctatagcgtgtaaggaaaaaggcataacaatttctgcggcagaaagctttaccggagggctgttttctgaatggctgacggatcatagcggtgcctcaaaattatttgccgggggcgttgtttgctatacaaacgacgtgaagcagaatgtgcttggtgtcaagaaggaaacattagatcgttttggggcggtcagcaaggagtgcgcatccgaactggctaagggtgttcaaaaactcactggcagcgatatcggcattagctttactggtgtagcaggacctgatgctcaagaagggcatgagcctgggcatgtgtttatcggcatttccgcaaatggtaaagaagaggttcacgagtttcactttgcgggctccagaacggggatcagaaaacgcggcgctaaatacggctgccatttaatcttaaagcttttagagcaaaaataatattttcagcacattatcctcctaagaaaacatgatttctctgatacattatgatattttgataggaatcacgccaagaaaaaatccgaatatgcgttcgcttttttcttggcaaatcccttcaaacagggtatagtatatgtagtggtaacataaaggaggaaaaaatagaatgagtgatcgtcaggcagccttagatatggctcttaaacaaatagaaaaacagttcggcaaaggttccattatgaaactgggagaaaagacagatacaagaatttctactgtaccaagcggctccctcgctcttgatacagcactgggaattggcggatatcctcgcggacggattattgaagtatacggtcctgaaagctcaggtaaaacaactgtggcgcttcatgcgattgctgaagttcagcagcagggcggacaagccgcgtttatcgatgcggagcatgcgttagatccggtatacgcgcaaaagctcggtgttaacatcgaagagcttttactgtctcagcctgacacaggcgagcaggcgcttgaaattgcggaagcattggttcgaagcggggcagttgacattgtcgttgtcgactctgtagccgctctcgttccgaaagcggaaattgaaggcgacatgggagattcgcatgtcggtttacaagcacgcttaatgtctcaagcgcttcgtaagctttcaggggccattaacaaatcgaagacaatcgcgattttcattaaccaaattcgtgaaaaagtcggcgttatgttcgggaacccagaaacaactcctggcggccgtgcgttgaaattctactcttccgtgcgtcttgaagtgcgccgtgctgaacagctgaaacaaggcaacgacgtaatggggaacaaaacgaaaatcaaagtcgtgaaaaacaaggtggctccgccgttccgtacagccgaggttgacattatgtacggagaaggcatttcaaaagaaggcgaaatcattgatctaggaactgaacttgatatcgtgcaaaaaagcggttcatggtactcttatgaagaagagcgtcttggccaaggccgtgaaaatgcaaaacaattcctgaaagaaaataaagatatcatgctgatgatccaggagcaaattcgcgaacattacggcttagataataacggagtagtgcagcagcaagctgaagagacacaagaagaactcgaatttgaagaataaaaataaaataagtttcaaatgatacaaaaggctgagtgaaaaactcagcttttttgtattttgcaaaaaaatgataaaaatattgctttttttgacaacttttttatggctttattcgtctaacaaaacgtgtgcaaaatggaatttattttgggaggaaaaaatgaatgacaagcccaacccgcagaagaactgcgaaacgcagacggagaaaactaaataaaagaggaaaactgttgcttggtcttttagcagtgatggtttgcattacgatttggaatgctcttcatcgaaatagtgaagaaaacgaaccatctcaagaaactgcagcggtttcaaataccgatcagaaaaaagaggtcaaaaagaaaactgccaaaaaatcagaggaacaaatcaaaacagtggatcgaaaccaaaaaatcagcaattatttagaagagatcggtttcagcggaacagccatgattgtcagaaatggagaaattgtaacaaataaaggttttggctatgctgaccgtaaacactacattcaaaataatccattgacatctttttatgtcggttcatcacaaaaagcgctgattgcaactgctattttgcagcttgaggaaaaggggaaacttcagacaagtgatccggtaagtacgtatttacctcattttcctaacggacaaacgattactttgaagaatctgcttacacatacatcggggataaacggacatattgaaggaaacggcgccattacgccggacgatttaataaaagacatagaactgcagggaatcaaacgtcagccgggcgtatgggactacaaggattccaactattctgttctcgcttatattattgctgaagtaagcggtgagtcctatgaacagtacataaagaatcatatttttaaacctgcgggaatgacgcatgcaggcttttacaaaacatatgaaaaagaaccttatcctgctgtcgggtataagatgaagggcggcaaaacagttacaccgtatatacctgatctatctcagctgtatggagccggtgatatttatatgagcgctatagatatgtacaaatttgaccaagcgctgatagacggaaaactgtattcgcaaaatagctatgaaaagatgtttacgccagggagcagctccacatacggcatgggattttatgttgctcccggaagctattcaaaccatggtgttatgccgggcttcaatatcttgaacagctttagcaaatctgggcaaaccattgttattttgttctcaaacattcaaaataatgctaaattgggccaagtgaacaataaaatataccagcttctgaatcaagaatgattggcgttcttcttttggatgaattgcattcggaacgtgaaaagacgactggcctgcaaacgttaagatggcaagcttgacaagtatttccgacacatttacaatgaagttgtaacatttgtttttttaacatgattgttaaaccatttaaacttgacaagggcgatgaacacactcattccctgtgaaggttctgtatgttgagaaaactagacaatgtacatgccgacactttttaagcaacaaccaagttcatagcaagaggaggtgaaagtatgaccccaattatgatggttctcatctccattttgctgattctactcggtttagttgttggctactttgttcgtaaaaccattgccgaagcgaaaattgcgggcgcacgcggtgcagccgagcaaattcttgaagatgcgaagcgtgatgctgaagcactgaaaaaagaagctctgcttgaagcaaaggatgaaatccacaaacttcgaatagatgctgaacaggaagttcgtgaaagacgaaatgagcttcaaaaacaagaaaaccgtttactccaaaaggaggaaaaccttgatcgcaaacatgagggaattgataaacgggaagcgatgttggagaagaaagatcattctctgaatgaacgacaacaacatattgaagagatggaaagcaaagtggatgagatgattcgtatgcagcagtcagagttggaacgaatttcgagtctgactcgtgatgaagcaaaacaaatcattcttgagcgggttgaaaacgagctttcacatgacatcgccatcatgacaaaagaaactgaaaaccgtgcgaaagaagaggcggataagaaagcgaaaaacattctttcactcgccttacagcgctgcgcagcggaccacgttgccgaaacaacggtatcagttgtcaatcttccaaatgatgagatgaaaggacgtatcatcggacgggaagggcgtaacattcgtacgcttgaaacgctgacaggaattgacctgattattgatgatacgcctgaagctgtcattctttccggatttgatccgatcagacgtgagacagccagaattgctcttgataaactcgttcaggatggccgtattcatccggcacggattgaagaaatggttgaaaaatctcgccgcgaggtcgatgactatattcgtgagatgggtgagcaaacgacatttgaggttggcgttcacggcctccacccagatctcatcaagatcctcggccgcttaaagttccgtacaagctacggtcaaaatgtgcttaagcattccatggaagtcgcattcttggccggtctaatggcatcggagcttggtgaagacgcaaagcttgctaaacgtgcgggtcttcttcacgacatcgggaaagcaattgaccatgaagtagaaggaagccacgttgaaatcggggtagagcttgcgaccaaatataaagagcacccagtcgtgattaacagtattgcatcacaccacggggatgaggagccgacttccattatcgctgtgctggtagctgcagcagatgcgctttccgctgcaagacctggcgcaagaagtgagacgctcgagaattatattcgaagacttgaaaaactcgaagaaatttctgagtcctacgaaggtgttgaaaaatcatttgccattcaggctggacgcgaagtgcgtattatggtgaagccggattcaattaatgatcttgaggctcatcgactggcgcgagatatccgcaagcgaattgaggacgagctcgattatccaggtcatattaaggtgacagtaatcagagagactcgagccgtagagtatgcaaaataaagtgatgcgctaagcatcactttatttttttgacgacaaggaattttcaagaagaaaggatttacaaaatgagaattttatttatcggagatgttgtcggttcaccgggccgtgacatggtcaaagaatatgtaccaaagctaaaaacaaaatataagcctcactttaccattattaatggtgaaaacgccgcacatggaaaaggcctgacggaaaaaatttatcacagcctaatccagtccggcgcagatgcaatcacaatggggaaccacacatgggacaaaaaagaaatatttgattttatagatgacgttccgaacttggttcgcccggcaaactttcctgaaggaacaccgggaaagggatcacatatgtgaaagcaaacggcaaagaactagcagtcattaatttgcagggacgtacgtttttgccgccgcttgatgacccgtttttaaaagcggacgaattgatcgcagaagctgcgaaaagaacaccgtacatttttatcgactttcatgccgaagcgacaagtgaaaagctcgcacttggctggtacacggatgggagggcgtcggctgtagtaggaactcatacacacgtgcaaacagcggataaccgcattttgccgaagggaacggcatatattactgatgtgggaatgactggcccgtatgatggtatactggggatggacagagagacgattattaagcgattcaaaacgaaccttccagtccggtttactgtcgctgaaggaaaaacaacgctcagcggagttgtcattgacattgacgatcaaacgaaaaaagccgtgaaaattgagcgtattttaatcaacgatgatcacatgttctttgaatagttgaacatatggttattttataaaaatattaaaaagaaaagcaggaatatagcaactccttagtgaatatagtaaaaatggaaggtagcccgctatttttgaaaagcattgtggggatggctttttggatagcaacatctaataatgattgttctaatgaacactcacttatccattgtaaaactaagggggagcagaaatggaaatcttaaaagtttcagcaaaatcgagtccaaattcagtggcaggtgcgcttgcaggcgtgttgagagagcgaggagccgccgagattcaagcgatcggagcgggtgcattaaaccaggctgtaaaagctgtggcgattgccaggggatttgtggcgcctagcggcgttgatttgatttgtattccggcttttacagatattcaaatcgatggggaagaaagaacagcgattaaattaatcgtggagcctcgctaaaaacaaataaagcattctcaacctgtttgcgtaatgcaaacaggttgtttttcatttattgtgatattttctcccaatagtatttttagcacataaatgagcgaatatacaaaatcagaaatgagctaaaacgtttcaaaaaaaattccgctcatttttcaagacagatacttttgtccttctggagaagacagtgctgtttacgcttattccatatcatggtacaatccgaatataacaagaatttttcaaggaggattgtacatgcagagtggaaagatgaaagctctaatgaaaaaggacggggcgttcggtgctgtgctgactgaagttcccattcctgagattgataaacatgaagtcctcataaaagtgaaagccgcttccatatgcggcacggatgtccacatttataattgggatcaatgggcacgtcagagaatcaaaacaccctatgttttcggccatgagttcagcggcatcgtagaggacgtgggagagaatgtcagcagtgtaaaagtgggagagtatgtgtctgcggaaacacacattgtctgtggtgaatgtgtcccttgcctaacaggaaaatctcatgtgtgtaccaatactgctataatcggagtggacacggcaggctgttttgcggagtatgtaaaagttccagctgataacatttggagaaatcccgctgatatggacccgtcgattgcttccattcaagagcctttaggaaatgcagttcataccgtactcgagagccagcctgcaggaggaacgactgcagtcattggatgcggaccgattggtcttatggctgttgcggttgcaaaagcagcaggagcttctcaggtgatagcaattgataagaatgaatacaggctgaggcttgcaaaacaaatgggagcgacttgtactgtttctattgaaaaagaagacccgctcaaaattgtaagcgctttaacgagtggggaaggagcagatcttgtttgtgagatgtcgggtcagccctcagcgattgcccaaggtcttgcgatggctgcgaatggcggaagatttcatattctcagcttgccggaacatccggtgacaattgatttgacgaacaaagtggtatttaaagggcttaccatccaaggaataacaggaagaaaaatgttttcaacatggcgccaggtgtctcagttgatcagttcaaacgtgatcgatcttgaacctgttattacccatcagtttccgttagaggagtttgaaaaaggtttcgaactgatgagaagcggccagtgcggaaaagtaattttaattccataaagggggataaacatgacgaaggaatttgattttttaaaagcagagcttgatagtatgaaagaaaaccatacatggcaagacataaaacagcttgaatctatgcagggtccatctgtcacagtgaatcaccaaaaagtcattcagctatcttctaataattacctcggattcacttcacatcttagactcatcaatgccgcacaggaggccgttcagcagtatggagccggcaccggatcagtgagaacgattgccggtacatttacaatgcatcaagagcttgagaaaaagctggcagcctttaaaaaaacggaggcggcacttgtattccaatcaggcttcacaacaaaccaaggcgtactttcaagtattctatcaaaagaggacattgtcatctcagatgaattgaaccatgcctctattattgacggaattcgactgacaaaggcggataaaaaggtgtatcagcacgtcaatatgagtgatttagagcgggtgctgagaaagtcaatgaattatcggatgcgtctgattgtgacagacggcgtattttccatggatggcaacatagctcctctgcctgatattgtagagctcgctgagaaatatgacgcatttgtgatggtggatgacgcccatgcatccggagtacttggcgaaaacggcaggggaacggtgaatcacttcggccttgacggcagagttcatattcaggtcggaacattaagcaaggcaatcggagtgctcggcggctacgctgcaggttcaaaggtgctgatcgattatttgcgccataaaggccgtccatttttattcagcacatctcatccgccggctgtcactgcagcttgtatggaagcaattgatgtcttgcttgaagagccggagcatatggagcgcttgtgggagaatactgcctattttaaagcaatgcttgtgaaaatgggcctgactctcacgaagagtgaaacgccgattcttcctattttaataggtgatgaaggtgtggcaaagcaattttcagatcagctcctttctcacggtgtttttgcccaaagtatcgttttcccgactgtagcaaagggaaaagccagaattcgcacgattataactgcagagcacaccaaagatgaactggatcaggcgcttgatgtcatcgaaaagacggcaaaggagctccagctattgtaacaagaggaagagtttactcttcctcttttgattccttattgattattattctcaatgagtgtacaatgataggttgccagttgtgcagagcttcaataacctttatactgaagggtggaagtttggtttgaaaggagaaaatatgacatgaatgaaaaacaaaaattagagagcggacaagttaatccatcggacaaaaaatccgagaaggattacagcaagtactttgaagctgtttacattccgccttctttaaaagacgcgaaaaaacgaggcaaggaagccgttacttatcataatgactttaaaatttctgaacaatttaaaggattgggagacggaagaaagttctatatccgtacgtacggctgccaaatgaatgaacacgatacagaggttatggcagggatctttatggcgctcggttacgaagcgacaaactctgttgacgatgccaatgtcattttgttaaatacatgtgcaatccgtgaaaatgctgaaaacaaggtgtttggtgagctcgggcacttaaaagcactgaaaaaaaacaatcccgatctgattttaggcgtgtgcggctgtatgtcccaagaggaatcagtcgtgaaccgtattttgaaaaaacatccgtttgtcgatatgattttcggaacgcataacattcatcgcctgccggagcttttgtcagaagcatacctttcaaaagaaatggttgtagaagtttggtctaaggaaggggacgttattgaaaaccttccgaaagtccgaaatggaaaaattaagggctgggtcaatatcatgtacggctgtgacaaattctgtacgtattgcattgtgccttacacacgcggaaaagaaagaagccgccgccctgaggatatcattcaggaagtgagaaggcttgcaagtgaaggctataaggaaattacactgttaggccaaaatgtaaacgcgtatggaaaagactttgaagatatgacttacggacttggtgatttgatggatgaactgagaaaaatcgatatcccgagaatccgttttacaacgagtcatccgcgcgactttgacgaccgcctcattgaagtgctggcaaaaggcggaaatctgcttgatcacattcatcttccggttcaatcaggaagctcagaagttctcaagctgatggcccgcaaatatgacagagagcgttacatggagctggtgcgaaaaattaaagaagcaatgccaaacgcttcattgacaacggacattatcgtcggatttccaaatgaaacggacgaacagtttgaagaaacgctttctctataccgtgaagtggagtttgacagcgcctatacgttcatttactctccgcgtgagggcactccggctgctaagatgaaagataatgtaccgatgcgtgtgaaaaaagaacgcctgcagcgtctgaacgcgctggtgaatgaaatttctgctaaaaaaatgaaggaatacgaaggcaaggttgtcgaagtattagttgaaggtgaaagcaaaaataaccctgatattcttgccggctatactgaaaaaagcaagctcgtcaatttcaaagggccgaaggaagccatcggcaaaatcgtccgcgtgaaaatccagcaagcgaaaacatggtcgcttgacggagaaatggtaggagaagcaatcgaggtgaaatgagatgacgctctactcaaaaaaagacattgtgcagcaggcacgaaaccttgcaaaaatgatctctgaaacagaagaggttgattttttcaaacgggctgaagcgcaaatcaatgagaatgacaaagtgtccacaatcgttaatcagattaaagccctgcaaaagcaggctgtcaatctgaagcattatgaaaagcatgaagcgctcaaacaagtagaagcaaaaattgacgcgctgcaagaagagcttgaagagattcctgttatccaggaattcagagactcgcagatggaggtaaatgacctactgcagctcgttgcacacaccatttccaaccaagtcacaaatgaaatcatcacatcaaccggaggcgacctgctgaaaggggaaaccggttcaaaggtgaagcattcaaataacagctgttctctctaaacacggtgcctttacaggcccgtgtttttttatcatttgtgcggttaaaaatgaactaaataatctatgtaccaaatgttcaattggtttttctgtgctcagccgcgtataaactttatcgcacttataagtaaagtttctaggcacccctgcatacaatggaacagaaactttgtatttttatattttatttataaaaatgcacactagacaaatgcccagcataagataacacgaagaagaacaaggaggcatgccggaatgtctgaatacagggaaattattacgaaggcagtagtagcgaaaggccgaaaattcacccaatgcaccaacaccatctcgcctgagaaaaaaccgagcagcattttgggtggttggattattaaccacaagtatgacgctgaaaaaattggaaaaacggtagaaattgaagggtattatgatataaacgtatggtactcttacgcggacaacacaaagacagaggttgtcacagaacgggtaaaatatgtagatgtcattaaactcagatacagagacaataattacttagatgatgagcatgaagtgattgccaaagtgcttcagcagccaaactgccttgaagtgaccatttcaccgaatggaaataaaatcgttgtgcaggcagaaagagaatttttggcggaagtggtaggggaaacaaaggtagttgttgaggtcaatcctgactgggaagaggatgacgaggaagattgggaagatgagcttgatgaagagcttgaagacatcaacccggagtttttagtgggagatcctgaagaataaaaaagggactaggggagacagtacccccaagtctcttttttatattgatatatcattcttttatcactttttgtttatgttataatgaaggttggaaaatagaaacgttgatacatagtgagggattaaacaatggccggttatacgcctatgatacagcaatatttaaaaataaaggcagagcaccaggatgcctttttattttttcgcctgggtgatttttatgaaatgttttttgaggacgccaaaaaagcgtcacaagagctggaaattacgttaacgagcagagacggcggtgcggctgaaaaaataccgatgtgcggtgtgccgtatcattctgcttccgcgtatatcgaacagcttattaaaaaaggctacaaagtggcgatctgtgaacagacggaagatccgaaagccgcaaagggcgttgtgaaaagagaagtggttcagcttattacgcccggaactgtaatggacggcaaaggcatccatgaatcggaaaataactttatcgcatctgtttcagcctgctcgaacggatacggacttgcgctgtctgatttaacaacgggagaaaatttggctgttttgattgaacggcttgaagacgtcatatcagaaatttattccgtcggcgcacgggaaatcgtggtttcaggaagcttggatgccgatacagtggcacagctgagagagcggtgcggtgcaacgatttcaattgaagacggagaaacagacgaacacgtaacgatcattgagcacttaaataatgaagatataacaaaaacatttctgcgcttatatacgtatttgaaaagaacccaaaagcgcagccttgatcatcttcagcccgtgcaggtgtatgagcttgaggaagcgatgaaaattgacttgtactcaaagcgtaatctggagctgaccgaaacgatccgttcaaaaaataaaaaaggctcccttttgtggctgctggatgaaacaaaaacggcaatgggaggccggctgcttaaacagtggattgaccggccgcttatcagagtcaatcaaatcgaagagcgccaagaaatggtggaaacattgatgtcccatttctttgaacgggaagatctgcgtgaacgtttaaaagaagtatatgacttagaacgccttgccggacgcgttgcattcggaaatgtcaatgcccgggatttgattcagctgaaggaatcgttaaagcaagttcctggcatcaaacagctggttgcttcactggctcatgacaaggccaaggaacgtgcagagcgcattgatccttgcggggatgtacttgaactgctggaagaagcgctgtacgaaaaccctcctttatctgtaaaagaagggaacctgattaaagatggttataatcaaaagcttgatgaatatcgtgatgcaagcagaaacggaaaagactggattgcccgcctggaacagcaggagcgggaatacacaggcattcgctctttaaaggtcggctttaataaagttttcggttattacattgaagtgactaaagcaaacttgcatttgcttgaggaagggcgttatgagcggaagcagacattaaccaatgcagagcgctacattacccctgaattaaaagaaaaagaagcgctcattttagaggcggaaaataacatctgtgagctggagtacgagctgtttaccgagctgcgcgagaaagtgaagcagtatattccgcggctacagcagcttgcaaaacagatgagcgagctggacgcactgcaatgctttgcgacaatcagtgaaaatcgtcactacacgaaaccggagttctctaaagatgaagtcgaagtgattgaaggcagacacccggttgttgaaaaagtcatggacagccaggaatatgtcccgaacaactgtatgatgggcgataacagacaaatgcttctcattacaggtccaaacatgtcagggaaaagcacgtatatgagacaaatcgcgctcatttccattatggcgcaaatcggctgctttgtacccgcgaaaaaagcggtgcttccgatttttgatcaaatttttacacgaatcggggctgcagatgatttgatttccggacaaagtacatttatggtagaaatgcttgaagcgaaaaatgcgattgtcaacgcgacgaaaaacagcctcattctgtttgatgaaatcgggcggggaacgtccacttatgacggcatggcgctggcacaggcgattattgaatatgttcacgatcatatcggcgccaagacgctgttcagcacacactatcacgagctgaccgttcttgaggacaagctgccccagctgaaaaacgttcatgttcgcgctgaagaatataacggaacggttgtctttcttcatcaaattaaagaaggtgccgctgataaaagctatggtatccatgtagctcagcttgccgaactgccgggagatctgattgcgcgcgctcaagatattttaaaagagcttgaacattcaggaaacaaaccggaagtgccggtgcagaaacctcaggtgaaagaagagccggcacagctgtccttttttgacgaagcggaaaagccggctgaaacaccaaagctttcaaaaaaagaaaagcaagtgatcgatgctttcaaatcacttaatatactggatatgacaccgcttgaagcgatgaatgaaatgtacaagctgcaaaagaaattacattaaaacggggtgatgaatgtggcaaaagtcatccagctgtcagatgagctttcaaataaaatagcggcgggcgaggttgtggaacggcccgcctcagtcgtcaaagaattggtggaaaatgcgatcgacgctgacagcacagtcattgaaatcgatattgaggaagcaggccttgcatccattcgggtcttggataacggcgaaggaatggagaatgaagattgcaagcgagctttccgccgccacgcaacgagtaaaataaaagatgaaaatgatttattcagggtgagaacgctcggtttcaggggagaagctctgccgagtatcgcgtcagtctctcatctggagattacaacaagcactggtgaaggagctgggacgaagctcgtcctccaaggaggaaacatcatttccgaatcgcgttcctcaagcaggaagggaactgaaattgtcgtttccaacctgttttttaacacaccggcccgtttgaaatatatgaaaaccgttcatacagagcttggaaacattacagatgtggttaaccgtattgctctggcgcatccagaggtatcgatccgcctgcgccatcatgggaaaaacctgcttcaaacgaacggaaacggagatgtgcgccatgtactggcagcgatttacggcacggctgtcgccaaaaaaatgcttccgctgcatgtgagctccttggattttgaagtaaagggatatatcgccctcccagagattacacgggcgtcgagaaactatatgtcgtctgtggtcaatggccgttacattaaaaatttcccgctcgtcaaagcggttcatgaaggctatcatacgcttctgccgatcggacgccatccgattacttttatagaaattacgatggacccgattttagtcgatgtcaacgtgcatccatcgaagcttgaggtccggctcagcaaggaaacagagcttcatgacttaatacgtgacggaattaaagatgtgtttaaacagcagcagctgattcctagtgcccaggtcccgaaaaaatcagcacctgccatcaaaaatgagcagcagtttataacctttgatgaaaagcctccggaaaaaaaagttccggaaaaatcgactgcgccatcttattcaccaatgaagctcagctcagtcgtgaaagagctggttgatgtggaggaagaattgcctcctctccaatttgatgctccacctatcgttgatcaggaacaaacccttgaggtgtccgatgtttcagaagaacagcctgaaacatttgagcaggaatgccatgaggaacagcagccagcgtctgagcgggttccaattatgtacccgatcggccagatgcacgggacttatatattggcacaaaacgaaaacggcctatatattatcgaccagcacgccgcccaagaacgtattaaatatgagtactttcgtgaaaaggtgggggaggttgagcctgaggtgcaggagatgattgtaccgctgacgttccactactccacaaatgaggctttgattattgaacagcacaaacaagagctcgaaagcgtcggtgtctttttagagtcattcggctctaacagttacatcgtccgctgccacccggcctggtttccaaagggagaagaagcagagctcatagaagaaatcattcagcaggtgctcgactccaaaaatatagatattaaaaaactccgtgaggaagcggcgattatgatgagctgcaaaggctccatcaaagcaaatcgccacctcagaaacgacgaaatcaaagcgcttctggacgacctccgaagcacatcagacccatttacatgcccgcacggccgcccgatcatcattcaccactcgacatatgagatggaaaagatgttcaaacgcgtgatgtagcgggggtggtaggcattgatccattctctgaatggatcaatgctttttttgtactccttcgagtgtcagattataagaaacggttgtaaacgtgtgagcagtgttaatgcattatacttcatggtccctccgtataacaaaatttccatttacaggcaattggaattaatgtatattttggatgagggggtggaaacacatggcatgtggtccgaagatcattatctttttggatgaacttgatgatccgaatgtaagaatcattttagaatgcagaatttaaattacaacattgtgttttgctccctgttcgtgtgaacagggagttttttcgtttatataactggtgatgtccaaatataaggtgttatgaattctccatatctgccatcggcattttaagctgcttctctattaggctggtcatcaaaagcaagttcagtgaaagccatcactgctgatatcacaacaagcaagatatctggaatataaatagactgcataaagtaatctgcaaaacagatcgttataagattgctgataaaatacagtataaaagcaaaaagtgcagtctttttcaatgaaagtgattttgccaaaatgatagagataatctttgtgagtgggtctatgattaaacctacagcaaagcaggctaaaataaataaagctaatgtttgattagaagcgtatgtgatgcccagtatggagaataagcctttcatcccgaagaaaaagccgccgaagatgactgcaagcgcaatggccgcgataaaagtgatagatacaattccgattaattttgatctgaggttaaaatctttagagtgctcgttctgttctttatggttcaagtatgacactcccttcacctgcttactcatacaaacagcacccttgaatcagcccaaaatatctataagtctgttttctgacgaaaatagtatagcatattttaacaaaaccaaaaaaggccctttccactggggaagggcctttttcatcatgttaactcctgagattcgccgaagctttctctttttttggccaaataaaatagctggctgtaatgagaaagtcaattcctataatgacagtccacagtttaagaatgccgctcaatgcttcggttcgggcagagtcattgataaaatagatcatccctgccaatagtcccgcaccaattaagtaggccagcacatgtcttagccagcctttcgcaccgtgcttggcatggtccattccaaaacgtttcagtggttttgttcctttttttgtcacataatattgaaacttttcatctgcccattgaatcatttgtttcccataagcgatcgatataccgatgtaaacagctgcaatcccatgggctgcggtcgctgaggctccgcggtaaaggtccacaccagttgccgctaacaagatcaaatcgataactggagttaaggcaaggaatagcagtcctaatgtatgtcgtttgaatacgtagcgtacagcaagccccaaaacaatgacaacccaaaacgcaatttcacagaaaacaatcatccatgcgataccgttcaatccattcccctcttttcaatacagttgtattatttaaataatatgttaccatctttatttttgtaacacaactgtattataaaaattgctctctcatttttttcttgttacaataaagctatgccaaaacaaattgaccatgagaaaagaagaaaacaaattgcagaagcaacgtggcgcgtcattttagaacgagggatggagggagcatcagccaggaacattgcaaaggaagcaggattgtcattaggtgcgctgcgccattatttctctacacaggatgaattgcttgcttttgcaatgaaacttgtccaagaaaaggtgactgaccgaattaaggacattgcagtgagggatttgctccctaaggaaaaagtgttgcaaattttgcttgaaatggtcccaacgaatgaagaaacgattagagagatggaggtttggtttgcttttactgcttacgccagacataaaaaggatatgtttgatgcgagtcatgacgggattttcagcggcatgcggaatttgattgcctatttagatgaatccgatttactgaagcagaatgctgataaagacattgaagctgagagactttacgcgcttgttgacggcttggctttacatgccatgcttgaccctgtgcgcgtgaataaagaccgaatcaagcgggtcattatgcagcatgtagagtcaatttgcgtggaagatacacgtgagacacaaaaacgacatccttaaggcactagtgcgaaaagcgattcttgttgggcatgcgtccaaaagagtcgcttttttattttcaaagaacaaggatctctgaaaaaaatggaaaacaatcatgctgtttggtaaagtggaatgaaagacggactgaggggtgaacactggtccatcgtttaagaactttacatgatagggatggtataaatgaatcttacttacaaggtgcatccaattaaaacaaggtatcagggctggacgaattattgctatatcattgaagatattgtaagcagatctgcaattgttgttgatccctcatgggaattgagtaagataaccactacactttctgaactcgaagcggaattaaaggcagtcgcattgacacactctcattatgatcatgtaaatctggtagacccgctgacgaagatgtttaacgctcaagtttatatgtcaaaaaaagaaattgattattatcaattccgatgcagaaatttaattagcctagatgatcatcagacaatcagcataggaaacacaagagcacaatgccttctcacaccggggcatacagccggcggaatgtgttatttgttttctgagagtatttttaccggagatacggtgtttacagaagggtgcggcatatgtgaggatgatggcagctctgcggaagagatgtttgatagcattcaaagaataaagtcggaggtttcaccccatgtacgggtgtatcctggtcactcatttggcaaatcgcccggccattcgataaaggatctttatcagcataatatttactttcaaattgataaaaaagaatattttgtgaaatttcgcactcgtaaaaaccaaaaaggtatttttgattttaaataatccttctgaatctattatcctatttttcttcgaatatctaaataatttttattttcgaaaatgattacatagaaggtgttatttattttgaaaactcatttgaaagaaaatgaagcgcattatcatgatatggcgccctatacgtgatccgggtcttttttcttatgttctgttatatctcctgatcctttattcctcaatggaaaaaagcagaaaaacaatggggcaaactgtaggaaaaattaacttgacggataatatttacagaggttaccatcaacatgaacatgctactatttatccggtcatcactattataaaatcatacagaagtgaaacacatctactaatcggaagggtggctttgagagaatgatcacatatgtttttccaggtcagggttcacaaaaacagggaatgggcagcgtcctattcgatgaatttaaagaactgacggatcaggcagatgagatcttaggatattctatcaaacgtctttgcctggaaaatccttattccaatttaaacaaaacgcaatttactcagccggcattatatgtggtaaacgcactaagctatctgaaaaaaatcaaggatgaagaagttaagcctgactttgtcgccgggcacagcttgggtgaatacaatgcgttatttgcagctgaagcctttgattttgagacaggtttacagcttgtcagaaaaagaggcgagctgatgagtctgataagcaacggcggtatggcagctgttatgggactaaatgaagagcaggttgcaaaggctctgaaaaaatatcatttacatgatgttgatatcgctaatgtgaatgccccatatcaaattgtaatttcaggaaaaaaagatgagattgaaaaagccgcatctctttttgaagcgatgactgaagttacaatggtactccccttaaacgtaagcggcgcgtttcattccagatacatgaataaggcaaaagaagaatttgaggagttccttcatgccttttatttttcgcctccgtctatcccggttatttctaatgtgtatgccaaaccgtatacatacgaattcatgaaacagacgctggctgatcaaattaatcattcagtgaaatggactgacagcataagctacttaatgaaaaaaggccatatggagtttgaggaggtagggcctggaaatgttttaactgggttaattcatcgcataaagaaagatgcggaagcaatgccccgctaaagcatttgcccctatggccatgtatctcatcaatcaggtctaaacacagatttcctttcatttaaggtataaagttttaaagattcaatcgttcgattgacactgtttctaattgaataactttatatactgttacataaagaggctcataaattaagttagacatttgaactatgtcagccggtctgtcaaaccatcgctcccacatctagatggtcctttttttaaccgcacccaccaatcatagagtcgatgttctttgctgatcctgttatcatgttacatcaattttgagatatcaacatacatctacgatcacgtcataaatgaaccgcatccagagcaccaatagcaatccttccaagttgaatctcctttactttttcacatatgtcttttccatttattaatttcatttcaatcgctgctatgtgctttaacaacatgcatggaaatgagaaatccaatagccgtcataaatataaaaaaagaaggttatacacatgaatgaaccgcttgtttttatgttttccgggcaaggttcccaatactatcacatggggaaagaactatttaaggaaaataccgtgtttcgccaatcaatgcttgaaatggatgccattgcagcacggcgaatcggcacatccattgttgaagaaatctaccatcaaggtaaacgtgtgtcagatccgtttgacagtattcttttttcccaccccgccatttttatgattgagtattccttatataaggttttggaagacaggggaatttatcctgattacgtattgggatcaagtctgggagaattcgcagcagcggcagtttctggtgtgtcagacgcagaggatatactggattgcatacttgaacaggctattatcatccagaattcctgcgataaaggaaaaatgctggccattcttgacaaaccgcaattgctgaatgatcatccgcaactgtttggaaatagtgaactcatttctatcaattatgattcgcacttcgtcatttctggtgaagaagatcatataaggaagattatggaggatttaaaggagaagcagattctttgccagctgcttcctgtgtcctatgcctttcattcttcgcttattgatccggcagagagtgcctatgcagaatttttaagatcaaaatcttttcaaaaaccgtcaataccgattgtatcgagcttaacgggaagctgccttcacgtaatggacgagaatttcttttggaatgcggtcagaaagccaatgatgtttcgtgaagcgattcgatatttggaaagccagcatacatgcaagtttatcgatttagggccatccggcaccttagctgcttttgtgaaacagctgattccgggtgattcagctgaccgttgctgctcaatcataacaccatttcatcaggagctgaaaaatctgaatacggttgagtatttccgtacaccagaaaggaagtttacaagatgattacatatgtctttccagggcaaggctcccagcaaaaggggatgggacaagggctatttgaacagtatcagcatttgacagatcaagcagatcaaatattgggctattcaatagagaagctatgtaccgaaaaatcatatctggatgtaaatcatactgaatacacgcagccggctttgtatgttgttaatgcactcagttacttgaagagagtggaggagaccggcagaaaacctgattttgcggcaggacacagcttaggagaatacaatgcgctgatggcagccggtgcatttgattttgaaaccggattaaggctcgtcaaaaaaagaggagaattgatgggacgaattacagggggcggaatggctgctgtgatcggcctgagtaaggaacaagttacagccgttttagaagagcaccgtctttatgacattgatgtggcaaatgaaaatacgccctggcaaattgtgatttctggcccgaaaaaagagattgaaaaagctcgggctgtttttgaaaacaccaaggatgtaaagctgtttcatccattaaatgtgagcggagcttttcattccagatatatgaatgaagccaaacaggtatttaagcaatatattgactcattccagtttgcacctttggcgatcccggttatctccaatgtctacgcagagccataccatcaagacagattaaaagatacattatctgaacaaatggacaacacagtgaaatggacggacagcattcgtttcctgatgggaagaggagaaatggagtttgcagagattgggcctggaactgttttaaccggtctcattcatcggattaaaaatgaagctgaaccattgacatatataccgaaaaagaaccccgcgatcagtgcgcatctaaaggagcaacgcaatgttcaagctgggattacggcagaatctttaggaagtgctgaatttaaacaagattatcatcttacatatgcttatcttgcaggaggaatgtaccgcggtattgcttcgaaagaaatggtagtaaagctgtcaagagcgggaatgatggggttctttggcacaggaggtctgagcctgaaagaggttgaagatgcgatccatgctatacaaggtgaattaggaaaaggacaagcctacggcatcaatctggtccacaatatgaaacatactgaatcagaagaaaaaatgatcgatcttttattgaggaatcaagtgagcattgtggaggcttcagcatttttaagtgtcactcctgcattagtaaggtaccgcgcaaaaggagtgaaacgaaatcaaaatggtgacgttatatgctcaaatcgtctcatagcaaaaatatcacggccggaagttgcagaatcatttctgagtcctgcgcctgagaatatgctgcaaaagcttttaggagaaaataaaatcactatgaacgaagctgagttgttgcggtgcattccgatggctgacgatatttgtgtagaagctgattcaggcggtcatacagatggcggtgtggcatacagcctgatgccggcgatgacatctttaagagatgaaatgatgaaaaaatatcaataccggaaaaaaataagagttggtgcagctggagggattggaacacctgaggcagcgatggcggcttttatgctaggggctgattttattctaacaggctcaatcaatcaatgtacggttgaggcggcaacaagtgataaagtaaaggatttgcttcagcagatgaatgtacaagatacagcctatgcgcctgcaggtgatatgtttgaatcgggcagtaaagtgcaggtgctaaagaaaggcgtgttctttcccgcacgggcaaacaagttatatgaactgtatcagcggtatgggtctatacgtgagctggatgcaaagatgctggcccagcttgaggagaaatactttaaacgcagtatagaagacatatataaagatattgcattgcattatcccgcggcagacattgagaaggctgaacaaaacccgaagcataaaatggctttgattttccgatggtacttcagatacagttcaaaattggcaatcagcggaagcgaacattcgaaggtcgattatcaaattcactgcggtcccgcgctgggagcctttaatcaatgggttaaagggtcgcaattagaaaattggcgaaaccgccacgtggatgaaatcgggaaaaaattaatgacagaaacggcagtattgcttcatgaacggatgcaatcgatgtatcagccgtcgcatgaaacagacaacataaaaataaaagtttgaatattatgaaaatatacctataaaaatcattaaaataatcccttgaaggagagagcgcattatggataaacagagaatctttgaagtactaatcaccaatatttgcgaggtgcttcctgaattagacggacacagatttgagcctgaagatcagttagttgagttaggagctgactctgtagacagagctgaaattatcacgatggtgctagaggatttatcgttaaaaatccctcgcattgagctatccggggtgaaaaacatcggtgaattagctgaggtgctttatgacaaagtgcaatctgcctgaggtggtggtgaccggtgtaggcgtcacggcctctatcggtcaagggaaagaggactttgcttcctcgctgctgtccggcagacatgcctttgatgtcatgaagcgttcaggcagacaaaaagacagccggtttatcggagccgaaattgcgtcattgtcttatcctgaccgactctccaaaaaaatgttgcgaaaagcatcattctccagccgcgctgcattggtaactctcacagaggcttgggaggaggctgaattggacgatgcagattcctcacgtatcggactggttgttggcggatcaaattttcagcagagagaaacctttgaagtttatgaaaggtatcaagaccgctccggttttatttcgccggcgtatggtctgtctttcatggatagcgatctttgcgggatatgtacagatcagtttggcatcacgggattagcatatacggtgggaggagcctcggccagcggccagttagcagtcattcatgcgattcagcaagtcctgtcaggcgaagttgatacttgcatagcacttggtgctttaatggatctttcttatatggaatgcgaggcgctaagggctttaggcgctatggggacggacaaatatgctgatgaacctgaaaaagcgtgccgtcccttcgatcaaaacagagacgggtttatctatggagaatcgtgcggtgcattggtaatagaacgaaaggagacggctttacgaagaggtctcaaaccttatgcagaattgtctggctggtcaatcaaactggacggaaaccggaatcctgatccttcattagaaggagaggttcatgtcatccagaaggcactggagcgtgccaggcttttaccagaagatattgattatattaatcctcatggaacaggctcttttattggagatgaaatagaattaaaggcgctccgtgcatgccggctttcccatgcttatatcaatgcaacaaaatcgataaccggacacgggcttagtgcggcgggcatcgtagagattatttctgttttgctgcaaatgaaaaaatctgccctgcatccgagcaggaatttggatcatccaatcgatgattcctttcattgggtaaatgagaaatcgatttcataccgcatcaaaaatgcgctgagcttaagcatggggtttggcggaatgaacaccgcggtttgtatacaaaacattgagaaatgtggaggcgaatcataaatggtttcagccggaatagaagcgatgaatgtctttggcggaacggcataccttgatgtcatggagctggccaaatacagacacttagatactgcgagatttgaaaacttattaatgaaagaaaaagcggtagcactgccttatgaagatcccgtgaccttcggagtcaatgcagctaagccgattattgatgctttatctgaagcagagaaggaccggattgaattgctgatcacttgctctgaatccgggatcgactttgggaaatcgttaagtacatatatccatgaatatttaggtctcaaccgcaactgccgtttgtttgaggttaaacaggcgtgttattcagggacagcgggatttcagatggcggtgaattttatattatcccagacttctccgggtgctaaagcactggttatcgccagtgatatttcacgttttttaatcgctgagggcggagacgctttaagcgaagattggtcttatgcggaaccgagcgccggagcgggagcggtggccgttttagttggcgaaaatcccgaggtgtttcaaatagatcccggagcaaatggttattacggctatgaagtgatggacacgtgccgccccattcccgacagtgaagcgggagattctgatctgtctttaatgtcatatttggattgctgcgaacagacctttctggaatatcaaaagcgtgtaccgggtgccaattatcaggacacgtttcaatatcttgcttaccatacgccctttggcgggatggtgaaaggtgcgcaccggacaatgatgcgtaaggtggcgaaggtgaaaacatccgggattgagacggattttttaactcgggtaaaaccaggtttaaactactgtcaacgggttggaaatattatgggggcagccttgtttctggcattggccagcacgatagaccaagggaggtttgattcgcctaaacgaattggctgtttttcctacggatccggctgctgttctgaattttacagcggaattacaactccgcaaggccaggagcgtcagcgaacatttggtattgagaagcatttggatcgccggtatcagctctccatggaagagtatgagctattgtttaaggggagcgggatggtgcggtttgggacgcgcaatgtaaagctggactttgagatgataccgggcatcatgcagtccactcaagagaagccgcgcttgtttttagaagaaatttctgagtttcatcggaagtacaggtggatctcgtgacctatcaaacgataaaggtccgctttcaagcgtcggtttgctatattacctttcaccgtcctgaagcgaataatacgattaatgacacgctgatagaagaatgcttgcaagtgttaaaccaatgtgaaacatcaacggtgacggttgtcgttttagaggggcttcccgaggtgttttgtttcggagctgattttcaagaaatctatcaggaaatgaaaaggggcagagaacaggcaagctcccaagagcctctctatgatttgtggctgaaattgcagaccggcccttatgtcacgatatctcatgtcaggggaaaagtgaatgccggcggtcttggatttgtatctgccacagatattgccattgctgatcagacggcgtcattcagtctctctgagctgctattcggcttgtaccctgcttgtgttttaccgtttctgatccgccgtatcggctggcagaaagcgcattatatgacgcttatgacaaagccgatttccgttcaggaagccagtgaatgggggttaatagatgcttttgatgctgaaagtgacgtgctgctgagaaagcatttattgcgtttgcggaggctgaataaaaaaggaatcgcacattataaacagtttatgagctcacttgatcatcaagtcaatcgtgcgaaagccaccgcgttaactgcaaatcaaaacatgttttctgatcctcaaaaccaaatgggaatcatcagatatgttgaaacagggcaattcccatgggaggatcagtaaccgtttaaaaatgacaatcagaaccgttaggaggacatcatgacgcattctgttgtagagcttatcgaaattgaatccgccattattcaggtaaagatgcaagatcgcactcataaaaacgcgttttcacaagaacttacagacggtttaattcaagcgtttgaatacatacggcagaacccaaaatacaaagcggtcattttgacaggatatgataattattttgcttcaggaggaacgcaagaaggactgcttcgaattcaacagggattgaccaagttcacagatgacaatctttattctctggcgctggattgtgagattccagttattgcggcaatgcagggccatggaattggaggcggctttgtcatggggctcttcgctgacatagtcattctgagcagagaaagcgtgtatacggctaattttatgaaatacggatttacgcctggaatgggcgctacctttatcgttcctaaaaaactgggtttcagcctgtcccaggaaatattattgaatgcgggcagctaccgcggagctgatcttgaaaaaagaggggttccttttaaggtgctgccccgtgcagaagtgttagattatgcagtggagctggcgcaagaactggcggaaaagccgagaaactcactggttacactgaaagatcatttggttgccccgcttcgcgatcagctgccgcgcgtcattgaacaggaattgatgatgcatgagaaaacatttcatcatgaagaagtcaaaagtagaatcaaaggtttatatggtaattaactgaaaatatatatataaattttgcaggtgaaatggaggcagcgtgatgagaaataatgataatatccgcatattagctaatccttctgtcagtcatggtgagcctttacatatatctgaaaagcagccggcaacaatacctgaagttttatacagaacggcggcagagcttggggatacaaagggaatcatttatttgcagccggatggaactgaagtttaccaatcatacagacgattatgggatgatggactgcgcattgcaaaagggcttcgccaatcaggcctgaaagcaaaacaaaacgtgattttgcagcttggtgacaattcacagcttctccctgcgttctgggggtgtgtgttaacaggggttgttccggctccattagccgttccgccaacgtatgctgaatcgagcagcggcactcaaaagctgaaagacgcatggacgcttcttgacaagccggcggtgattacggaccgggggatgcaccaggaaatgctcgattgggcaaaagaacaagggcttgaagggttcagggcaattattgtagaggatctgctcagcgctgaagcggacacagattggcatcaatccagtcctgaagacttagcgcttttattgctgacttcaggcagtacgggaacgcccaaagcagttatgcttaatcatcgtaacattatgagcatggtgaaagggattattcaaatgcaaggcttcaccagagaggatattacgtttaactggatgccgtttgaccatgtcggagggatcggaatgctgcatttgcgggatgtttatcttggctgtcaggaaattaacgtctcaagcgaaacaatcttaatggagccgttgaaatggctggattggattgatcattaccgagcttctgttacgtgggcgccgaattttgcgtttggtctggttactgattttgcagaagaaataaaagataggaaatgggatctgtcttcaatgcgatacatgctcaatggcggtgaagcaatggtagccaaggtagggcgcagaatacttgagcttttagaaccacatggactgcctgctgacgccatccgacctgcatggggaatgtccgaaacttcatcgggcgttattttttctcatgaatttacccgggctggaacaagtgatgatgatcattttgttgaaataggctctccaatccccggcttctctatgagaattgtgaatgaccgtaatgaattggttgaagagggcgagatcggccgttttcaagtctcgggtctttctgttactagcggttattaccagcggcctgatttgaatgagagtgtgtttacagaagacggctggtttgaaaccggagatcttggctttttgcgaaacgggcgcttaaccataacaggccgtacgaaagatgcaattatcattaacggcattaattattacagtcatgcaattgagtctgcagttgaagaattatctgaaattgaaacttcttatactgctgcttgcgctgtccgtctgggccagaattcaacagatcagctggctatcttctttgttacttccgcaaaattaaatgatgagcagatgtctcagcttcttagaaacatacaatcccatgtctcacaggtgatcggagtcaccccggaatatttgctgcctgtacaaaaagaagagattccaaaaacggctatcggaaagatccagcgcacccagctaaaaacttcatttgaaaatggagagttcgaccacttgctacataaacccaatcggatgaacgatgcagtccaggatgaggagatgcagcaagcagaccaggtgaaaagagtaagggaagaaatacagaagcatctgctcacctgtttgactgaggagctgcacgtttcccgcgattgggtggagccaaatgcaaatatccaaagtcttggtgtgaattctatcaagatgatgaagctcattcgatcgatcgagaaaaactaccatatcaaactaacagccagagagatacatcaatatcctacaattgaacgcttagccagctatctatcagaacatgaagacctcagcagcttgtctgctgacaaaaagggcacggacacatataaaaccgaaccggaaaggagtcaggcaacttttcagcctctctctgaggttcaaaaaggattatggacattgcaaaaaatgtcacccgaaaaaagtgcatatcacgtacccctctgttttaaattttcgtcagggcttcaccatgaaacattccagcaggctttcggccttgtattgaatcagcacccaatcttaaagcacgtcatccaagagaaagacggagtgccatttcttaaaaatgagccagcactttcaattgaaatcaagacagaaaatatctcaagtatgaaagagtctgatattcctgcttttcttagaaagaaagtaaaggaaccgtatgtaaaggaaaacagcccgttagtgcgtgtcatgagcttttccagatttgaacaagagcattttttattagttgtcattcaccatttgatttttgacggagtttcgtctgtcacatttatacgcagtctgtttgatacctatcagcttcttttaaaaggacagcagccggaaatagctgtttctcctgccatttatcatgattttgcggcatgggagaaaaacatgcttgccggcaaagacggtgtgaagcatcgtacatattggcagaaacagctatcgggaactttgccgaatcttcagctgcctaaggtcagcgcaagttcagtctctgagtttagagaggatacatacaccaggcggctgtccagcggcttcatgaatcaggtcagaatgtttgcgaaagagcattctgtaaatgtcacgacggtattcttaagctgctatatgctgctgcttggccgttacaccggccaaaaggaacagatcgtcggcatgccggccatggtgaggccggaagaaagatttgatgatgccattggacattttctcaatatgctcccgattcggagtgagctgaacccggcagacactttttctagctttatttcaaaattgcaattaacgatattggatggacttgatcatgcagcatatccttttccaaaaatggtgagggatctgaatattcctcgcagtcaagcaggttcaccggtatttcaaaccgcttttttctatcagaattttcttcaatccggaagctatcaaagcttgctgagccgctatgctgacttcttttctgtcgatttcgttgagtgtattcaccaagagggcgaatacgaattagtatttgaactgtgggaaacagaagaaaaaatggagctgaacatcaagtacaatactgggctgtttgatgcggcttctatatccgccatgttcgaccattttgtttatgtaacagagcaggcgatgttgaatccatctcagcctttaaaagagtattctttattacctgaggcagagaagcagatgattctcaaaacatggaacgccacaggaaaaacgtatccatatataacttttcatgagttgtttgagcagcaggcgaaaaagacgcctgatagaacggctgtcagctatgaaggtcaaacattgacgtatcgggagcttgatgagaaaagcacacagctggccatttatttgcaggcgcatggagtgggtcctgaccgtctggcgggaatctatgtggatcgatcgctggatatgctagtgggtttattagcgatcctcaaggctgggggagcgtatgtgccgctagacccgtcctatccggctgaacgattagaatacatgcttgaggacagtgaagttttcattacactgacgacatcggaattagtaaatacgttgagttggaacggtgtcacaacagctcttttagatcaagattgggatgaaattgctcaaacagcctctgatcgaaaagtgcttacacgcactgtcacgccggagaacttggcatatgtcatttatacatccggcagcacaggaaagccaaaaggtgtcatgatactgcataaagctttgacaaactttctcgtttcgatgggggaaacaccaggtcttactgcagaggataaaatgcttgctgtcacaacctattgttttgatatcgcagttctggaattatttttgcctttaataaagggcgcacactgctatatttgtcaaacggagcatacaaaagacgttgaaaaactgaaacgggacatccgcacgatcaaaccgacagtgatgcaggcaacccccgctacgtggaagatgctcttttattcaggctgggaaaatgaagagagcgtgaaaattttatgcggaggcgaagcattgcctgagacattaaaacgatatttcttagatacgggcagcgaagcctggaatatgttcgggccaaccgaaacaactatctggtcagcggttcagcgcattaacgatgaatgctctcatgccacgataggaaggccaatcgccaatacacaaatctatattacggattctcagctcgcgccagtgccggcaggtgtcccgggtgagctgtgcattgcaggagacggtgtggcgaagggctactacaaaaaggaagaattaacggactcgagattcattgacaacccttttgagcctgggtctaagctttatagaacgggagacatggcccgctggcttccgggagggcgaattgaatatataggccgcatcgataatcaagtaaaaatccgcggattccgtattgaacttggtgatattgaaagcaggcttagtgagcatcccggcattctggaatgcgttgtggtcgcagatatggataacctggctgcctattatacagctaaacatgcaaatgcttctctcacagcgagagagctgcgtcattttgtgaaaaacgctttgcctgcctttatggtgccttcttattttattcagcttgatcatatgccgttaactccgaacggaaagatagatagaaacagccttaagaatatcgatttatcaggggagcagctaaagcaaaggcagacctctcctaagaacattcaggatactgtttttaccatttggcaggaagtgctgaaaacgagtgacattgaatgggatgacggatttttcgatgtgggcggggattcgcttctcgcggtcactgtggctgatcgtatcaaacatgaactatcctgtgagttttctgtcacagacctgtttgagtattcaacgattaaaaatatcagccagtacatcactgaacagcgaatgggcgatgcaagtgaccatatgccgacagacccggcagctcatatagaagatcagtctaccgagatgagtgatctcccagactattatgacgatagtgtagcgattattggcatatcgtgtgaatttccaggggcaaaaaatcatgatgaattttgggagaacctcagagacggcaaggaaagcatagcgtttttcaataaagaagagcttcagcgctttggcatttcaaaggagatagcggagaatgccgactatgtccctgctaaagcttcaattgaggggaaagacagatttgatccaagcttctttcaaatctctcctaaagacgctgaatttatggaccctcagcttcggatgctgctgactcattcatggaaagcaatagaagatgccggttatgctgcgagacagattccgcaaaccagtgtttttatgtcggcaagcaataattcttatcgcgcgctgctgccgtcagatacaacagagagcctggagacgccggacggctatgtttcgtgggtgcttgcacagagcgggacgatcccgacaatgatttctcataagctcgggctgagagggccaagctatttcgttcatgccaactgctcatcatctctgattggattgcattctgcctataaaagcctcctgtcgggtgaatctgattatgctttagttggcggtgcaacgctgcataccgagtcaaatatcggatatgtgcatcagccggggctgaacttttcgagtgatggacatattaaagcttttgacgcttcagctgacggaatgataggcggtgagggcgttgctgttatattgctgaaaaaagcagctgatgcagtaaaggacggggatcatatctatgccttgctgagaggcattggtgtaaataacgacggcgctgacaaagtcggcttttatgctccaagcgttaaaggccaggctgacgtggtccaacaggtcatgaatcaaacgaaggtacagcctgaatccatctgctatgtagaagcacacgggaccggaacgaagctgggggacccgatcgagctggcggctttaacaaacgtttacaggcaatatacaaataaaacgcaattttgcggcattgggtcggtgaaaaccaatatcggacatttagatacagccgccggtcttgcgggctgcattaaggttgtgatgagtctttatcatcaagagcttgcaccgagtatcaattataaggagccgaatccaaatacagacttagccagctctcctttttacgtcgtcgatcaaaagaaaacgttaagccgtgagatcaaaacgcacagggctgcacttagctcgttcgggcttggcgggacaaatacccatgccatttttgaacaattcaaaagggattcagataagggaaagatagacggaacctgcatcgtcccgatctcggcgaaaaataaagagaggctgcaagagtatgcagaagacattctggcctatttagaaagaagagggcttgagaacagccagctgcctgattttgcgtatacccttcaggtggggcgcgaagcgatggagcatcgcgttgtctttattgccgatcatgtaaatgagttaaaacagaggctcacagattttatcaatggaaatacagcgattgaaggctgttttcaaggaagtaagcacaatgccagagaggtttcatggctgacggaggatgaggacagcgctgaactcatacgtaagtggatggccaaaggaaaagtaaacaagcttgcagaaatgtggagcaagggagcgcatatagattggatgcagctttacaagggagagcgcccaaacagaatgagtctgccgacttatccatttgcaaaggaacgatactggccgtcgcaggatgaccgcaaaccggtggcgcagatatccggaaatcagacagggatcggctctattcatccattgcttcatcagaatacatctgatttttctgaacagaaattcagttcggttttcactggtgacgaatttttcctgagagaccatgtggtaagaggaaagcctgtgcttcctggtgttgcgtaccttgaaatggcgtacgcggctataaaccaggcggcaggaagtgaaattggccaagatgtcagaatcagattgaatcatacagtctgggttcagcctgttgtggttgacagacattcagctcaagtggatatcagtctctttcctgaagaagatggaaaaatcacctttgacatttacagtacacaggaagacggggacgaccctgttattcatagtcaaggcagtgcggagctggcatctgccgccgaaacgccagtcgcagatctcactgaaatttcacgccgctgcggcaaaggaaagatgtcgcctgatcaattttacgaagaaggcagaagcagaggaatgttccatggtccggcctttcaaggaattaagaatgtgaatataggaaacagagaggttttggcgcagctgcagcttccagaaatcgtttctggaacgaatgaacagtttgtgctgcacccaagtatcatggattccgccttgcagacagcaacaatatgtatcatgcaggaattgacggatcaaaagctgattttgccatttgcgcttgaggagcttgaggtgatcaaagggtgttcttcttctatgtgggcttatgcccgcttaagtgacagcgatcactccggaggggttgttcagaaagcggatatcgatgtcattgacgagagtggaagcgtatgtgtcaggatcaaaggattctcaacgagagtattagaaggggaggttcatacttcaaagccttcaacacggcacgaacgcttaatgcttgaaccggtgtgggaaaaacagaatgaagaacgagaggacgaagatccttcgtacacggagcatatcattgttctcttcgaaactgaacgaagtgtcacagacagcattgcctcccacatgaaagatgcccgtgtgattactctaaacgaagctgtaggacatattgctgaacgttatcaatgttacatgcagaacatttttgaactcctgcaaagcaaggtccataagctttctgcaggccgtatcatcattcaagcgattgttccgctggaaaaagagaagcaattgtttgccggcgtttccggtctgtttaaaacagcagaaatagagttcagcaaactgactgctcaggtcatcgaaattgagaaacctgaagagatgatagaccttcacctcaagctgaaagacgacagccggagaccatttgacaaacagattcgatatgaggctggacaccgttttgtgaaaggctggagggaaatggtgcttccttcagctgatacgcttcacatgccgtggagagacgaaggcgtttatctaatcacaggcggagcaggaagcttaggccttctgtttgcaaaggaaattgccaatcgaactggccggtctactattgtgctgacgggacgatctgttttaagtgaggataaggaaaacgaactggaggctcttcgaagcatcggagcggaggttgtctatcgagaggctgatgtaagtgatcagcatgcggttcatcatctttttgaggaaatcaaagaaagatatggcactctcaatggaattattcacggtgcaggcagcattaaagatcacttcatcattcataaaacgaatgaagagtttcaagaagtattgcagccaaaagtgagcgggttgttacatgtagacgaatgcagcaaggatttcccattggactttttcattttcttctcatctgtttcgggatgtttaggaaacgctggacaagccgattatgcggcagccaattcgtttatggatgcatttgctgaataccgccgttctcttgcggcatcaaaaaagagattcggctccaccatttccttcaattggccgttatgggaagaaggcggtatgcaagtcggcgctgaagatgaaaagagaatgctgaaaacgacgggaatggtcccgatgccgacagatagtggcttgaaagcattttatcaagggatagcatctgataagccgcaagtttttgtgatggaaggacagcttcagaaaatgaaacaaaaactgctttccgcaggatcgaaagccaagcggaacgatcagagaaagacggatcaggatcaaggacaaactagaaaattggaagcagccttaatccaaatggttggcgcaattttgaaagtaaacactgacgatatcgatgtcaacacagagctgagtgagtacggattcgactcagttacattcactgtctttacaaacaagatcaacgaaaaatttcagttggagctaacaccgaccattttctttgaatatggcagcgtccaaagcctggccgaatatgtagttgctgcgtatcagggcgaatggaatcaagatgctactgctaaaggcatagatgaaagaacaaactcattgcacagtttaaacagcctggaggcatcattaagcaacatggtcagtgcaattttaaaagtaaatagtgaagatattgatgtcaatacagagctgagtgaatacggatttgattccgttacatttacggtctttacaaacaagattaacgaagaatttcagttggagctaacgccgaccattttctttgaatatggaagtatccaaagcctggctgagtatttgactgctgaacatgaggacaccctggttcaggagcgcgaaaaaccagaggggcaggaagagttacagacaaaatcccctgaagcgccgaaaatcacatcacgtagaaagcgccgctttacacagcctgttattgcaaaagcagaaagaaacaaaaagcaggctgccgattttgagccggttgcaattgtcggcatcagcggccgattccctggcgctatggatatagatgaattttggaaaaacctagaaggagggaaagacagcatcacagaagttccaaaagatcgatggaattggcgggagcattatggaaacccagacactgacgtcaataaaactgacatcaaatggggcgggtttattgatggtgtcgcagagtttgatccgttgttttttggtatttcgccgcgagaagctgattatgtagaccctcagcagcgcttgttaatgacatacgtgtggaaggcactggaagatgcgggttgctcgccgcaaagcctttcgggtacagggaccggtatctttatcggtacgggaaacaccggttataaagatctattccatagagcgaatcttccaattgaaggccatgctgctacaggtcatatgattccttcggtaggcccgaatagaatgagttattttttaaatattcatggtccgagcgaaccagtagagacggcctgttccagttctcttgtagccattcaccgtgctgtgactgcgatgcaaaacggtgattgtgagatggcgatcgctggaggcgtgaatacgatcttaaccgaggaggcgcatattagctacagcaaggcgggtatgctcagcaaagacggcaggtgtaaaaccttctccgccgatgcgaatggctatgccagaggcgaaggggtcggaatggtcatgttgaaaaagctggaagatgccgagcgcgacggaaatcatatttatggcgttattcggggcacggcggaaaatcacggcggaagagccaataccctgacatcgcctaatccgaaagcacaagctgatttgttggtgcgtgcatatcgccaagcaggcatagatccaagcactgtcacatatatcgaagcacatggaacagggacggaattgggcgatccgattgaaataaatgggctgaaagccgcgtttaaggaactatccaatatgagaggcgagagccagccggttgttccggatcaccgttgcggcatcggctcagttaaaagcaatatcggtcatttagagctagcagccggtatttccggtttgatcaaagtgcttttgcaaatgaagcataaaacgttagtgaaaagcctgcattgcgagacgcttaatccttatcttcagctgactgacagtccgttttacatcgttcaggaaaaacaggaatggaagtctgtcacagatcgtgacggaaacgagcttccgcgccgtgccggaatcagttcgtttgggattggcggagtgaacgcgcatattgtggttgaagaatatatgccaaaagccaattcagaacacacggctacaggacagccaaacgtgattgtgctgtcggctaaaaataaaagcaggctgatagatcgtgctttgcaattgcttgaggcgattcgcaataaaaaatatacagatcaggagttgcaccgcatcgcttacaccctgcaggtcgggcgcgaagaaatggatgagcgtctggcgtgtgttgcggggacaatgcaggaacttgaagagaaactgcaggcgtttgttgacggtaaggaagaaacagacgaatttttccggggacagtctcatcgaaataaagagacccagactatttttacagcagatgaagatatggcgttggcacttgatgcttggatcagaaaaagaaaatacgccaaacttgctgatttatgggtcaaaggggtctcaatccagtggaacacattatacggagagaccaaaccgcgcctgatcagcctcccttcatatccgtttgcgaaggatcactattgggtgccggcaaaggaacgttcagaaagagacaaaaaagaactggttaatgcgattgaagatcgggctgcatgctttttgacgaaacaatggagtttgagtccaattggctcagcagtgccggggacaagaaccgttgccatcctgtgcaatcaagagacagcagatttagcagcagaattgtcttcgtattttccgaatcatctcttattagatgtgagccggatagaaaatgatcagtcagacattgattggaaagagtttgacggcctagtggatgtcatcggatgcggtagggatgatgagggccggctggattggattgaatgggtgcaaagactggttgaattcgggcataaagaggggctcaggctgctttgtgtgacgaaggggctcgaatcgtttcaaaacacatctgtccggatggctggcgcctcacgggctgggttgtatcgaatgctccaatgcgagtacagccatcttatatcaaggcatatggatgctgaggaggttactgatcatcgccgtctcgcgaagttgatcgctgatgagttttattccgattctcatgatgccgaggtttgctacagagatggtttacggtaccaagcttttctaaaagctcatccggaaacaggtaaggccacggaacaaagcacggtcttcccgaaagatcatgtacttctcattacaggcggcacacgaggcatcggactattatgcgcccgtcattttgcagagtgctatggagtgaaaaaactggtgctgaccggacgagaacagcttcctccgcgagaggagtgggcgcgttttaagacatcaaacacatcattggcagagaaaatccaggcagtgcgggagctggaagcgaagggtgtacaggtggagatgctgtcgctgacgttatctgatgatgctcaggttgagcaaacgctgcaacatatcaagcgaacattaggaccgattggcggtgtcattcattgtgcaggtctgacggatatggatacgctggcatttatccgaaaaacttcagatgatatccagcgggtgatggaacctaaggtgtcaggtcttacaacgttatatcgccatgtgtgtaacgagcctttacagttttttgtcttattttcttctgtttcagccattattccggagctttcggcgggacaagctgactatgcgatggccaatagctatatggattattttgcagaagcacatcagaaacatgcgccgatcatcagtgttcagtggccgaactggaaagaaaccggtatgggtgaagtgacaaatcaagcgtatcgggaaagcggcttgttgagcattacgaattcagaaggcttacgttttctagatcaaattgtatcgaaaatgttcggaccggttgttctccctgcgatggcgaatcaaacaaactgggagccggaactgctgatgaagaggaggaaaccgcatgagggcggtttgcaggaagctgctttacagagcccgccagccagagacattgaagaggccgatgaagtttccaaatgtgatgggttattatctgaaacacagtcctggctagttgatctgtttaccgaagagctgagaatagatcgtgaagacttcgagattgacggggtgtttcaggattatggcgtggattcgatcattttggcacaagtgctccagcgtataaaccgcaaattagaagcagcactcgatccatcgattctatatgaatacccgacaattcaaaggttcgcagattggctgatcggttcttattccgaaaggctgtccgctttattcggaggcaggatatcggatgcatcagcacctttggagaacaaaatagaggcggaggcatctgttcctgcggaggatcgagctcttacacctcagattcaggcgccagtgattttgtcaccggactctcatgcagaaggtattgccgttgtcggactctcttgccgattccctggggcagatacattggagtcatattggtcgttactatccgaggggcgttcgtcaatcggcccgattccggcagagcgttggggctgtaagacgccatattatgccggcacgattgatggcgtcagctattttgatcctgatttctttttgcttcacgaagaagacgtaagggcgatggatccgcaagcactgctcgtgttggaagagtgtctgaaactcttgtatcacgccggttatacacctgaggaaataaagggcaagcccgtcggtgtttatatcggaggcagaagccagcacaaacctgatgaagagagccttgatcatgccaagaatccgatcgtgacagtcggtcaaaattatttagcggctaatctttcacaattttttgatgtccgcggcccgagtgttgtagttgacaccgcatgctcgtcagctttggtcggcatgaatatggccattcaggcgctgcgtggcggagatattcaatccgccatagtcggcggtgtcagcttactgagctcagatgcctctcacaggctgtttgaccggcgcggcattttaagcaagcattcatgcttccatgtgtttgatgagcgtgctgatggagttgtgttaggtgaaggcgtcggaatggtcatgttaaaaacggtaaaacaggcactggaagacggagataccatatatgctgttgtgaaagcggcctcggtcaataatgacggaagaacggcggggcctgcaacacctaatctggaggcgcaaaaggaagtcatgaaagatgcgctttccaaaagcggaaaaaaaccagaggacatcagctatcttgaggcaaacgggtcaggttcaatcgtaaccgatctccttgagctaaaagcgatccaatcagtgtaccgttctgggcactcatcgcctctttctcttggctcaatcaagccgaacatcgggcatccgctatgtgctgaagggatcgccagcttcattaaggttgtgcttatgctgaaagagcgccgctttgtcccatttttatcaggtgaaaaagagatggcgcatttcgatcaacagaaagcgaacatcacgttcagccgagccctggaaaaatggacagattcgcagcctactgcggctattaactgctttgccgatggggggacgaatgcccatgtcatcgtagaggcgtgggaaaaagatgaaaaacacgccatcaagcgcagtccaatatcgcctcctcaattaaagaaacgaatgctttcgccaggcgagacaaagctggaagcggagacttcgaaaatgactgcggcaaacatatgggatacttatgaggtggaggtctaacgtgaaaaagataacgaaacaactcacattatcgttaaaaaatccgtttatttatcaccatgtggtttacggacaaaatgtcctgccgggattggcttatatcgatataatctaccagatattcagagaacacggcttctcctgctcagagcttcagctgcggaatttatctatctatcagccattgacgacggaacaggatgcagtaattgttctgaatatccaatgcgcggagaaaaaagaaggaaagtggcaaatcacagccaagggaattgaaaaacgtgacgggaaagaagcttcggaagaaaagctctatatgaaggctgacatgcacgcagactccccagccatatttgaagaaacactggatttcagtcaaatcaaagcatctgcacagaacgttgttcagcttgatgatgtatatgaacaatgcagacgtcaggaattggtgcacagcgaatatatgaaagcaaaaggctgcatctatgaagaggaagacggcgttcttcttgagctttctctcggttcggaagccatgcttcacgcagaaggctttatgtttcacccgactctcatagacgggagcggggtgggtgccaatcatttgctcacatctttgcttaaaggagaacagaggctgtatttgcctctgttctatgaatccttttccgcttctgcacttttgcagtcggattgcatgacaagaattaagcgctcctccgtccggcgggaaaaagagctgatttatgtaacacttgaattttttaatgcgtcgggagaaaaagtggctgagttgaaaaactttacaagcaaattggtgcgagaagcggagctgattagcggaaaacatcaagatgcacaggagacacagatgacaagagcggacactgttgagcgtgataaacctgctgacatggtttcttctcccgttgattcctacagcggggctgaacagttcgtaagccaattaattgcagagaaaatcaataagccggtagaacaagttgaaaaacaggtcggttattaccaaatgggactgaattcatcgggcttgcttgaggtggtagaaacgatcagtgataagatcggtgagagcctttcgccgactcttctgtttgagcataccaccatagcggagctgtcagcgtttcttgccgaggaatatgctgagcattttagtgccgctggttcccttggccttggccagaatgaaagagcacgcgtttccgacacaataaacgatcgtaagactgttgaagcttctcgtcctgcacctgttgaggcagcaggcgatattgcgattatcggcttggcgggcaggtatccgaaggcagccaatattcatgaattttggaacaatctgaaagaggggaaggactgcgttagcgagattcctgagtcgcgctgggattggcagcgacttgaaggaatcacatctccttcgggtaaggacatttcgaaatggggaggatttattgatgatcccgactgcttcgatccccaatttttcagaatcacgccaagagaagcggagacaatggaccctcaagagcggctgtttttagaaacatgctgggaaacgattgaggatgcgggctatacgccaaagacgttggccaagcctaaaggacgaaataaaaggcagcatgtaggagtttttgccggtgtcatgcacaaggattatacattagtcggagctgaagaagcatcagcagaaaacgtgtttcctctctcgctcaactatgcgcaaatcgccaaccgtgtttcttacttttgtaatttccacggtccgagtatggctgtcgatacggtatgttcatcctctttgaccgcagtgcacttggcgttggaaagcatacgtcacggtgagtgcgatgttgcgttagcaggcggagtgaacctgtctttgcacccgaataaatatatgacatacggggtctgggatatgttttccactgacgggcactgccgtacgtttggaaaggatggggacggttatgtgcctgccgagggtataggcgcggttttattaaagcctttgcgccaggcggagaaagacggagatcgcatttatgcagttattaaaggaagtgctgtgaatcatgtgggcactgtaagcggcatttcagtgccgagccctgtttctcaagctgatctgattgagacatgcttggagaaaacgggaatcgacccgcggacgatcagttatgtggaagcccatggaaccggcacgtccttaggagatccgatcgaaatacagggattagtgaaagcgttccgccaatatacgcaggatcggcagttctgttcaatcggttctgtaaagtcaaacattgggcacgccgaatccgccgcggggatcagcggtttaagcaaggttgcccttcagcttcaccatcaaaaacttgtgccttctttgcattcggaagaactgaatccgtacgttgattttgaaaagtctccattttatgtacagcatgaaacagaaacgtggaagcagcctgttatcaaggagaatggggaagaggtcccttatccgcggcgggcgggtatcagttccttcggagcaactggttcaaacgcacatattatccttgaggaatatattcctcaaacagcggagcaggacgtttctttgtcctcagattctgacatatccgcagttattccgctttctgcccgtaatcaagaacgtcttcgtgtatatgcaaaacgtctcttggattttcttcatgatgggattcagattagagatttggcgtatacattgcaggtaggccgtgaaccgatggaagaacgggtttctttcttagcatccggaattcaagaattgagcgaccaattgaaggcttttatagaaggacgaaaaaccattcagcattgctggaagggccgcgtgtcaagaggaagcgaaccatcgcgtcccggcgaatcggtacataaattgctggagcaaagaaaactcgatcaaattgcggagcagtgggcgaacggatctggtgttgactggaagctgctttacgagggaaacaaaccaaagcggatcagcctgccgacttacccatttgagagggtgcgttattgggtgccgaaagcggagaaaaagactgatcgtttaaaggaggagcgacacatcctgcatcctcttctgcatcaaaatgtgtccgacatatcgggtgtccgcttccgttcagcgtttacaggacgtgaatttttcttgaaggatcatgtcataaagggcgaacacgttttacctggcgcagctttattggagatggttcgggcagctgtggaaagggcagctgcggatcagttcccgacaggattccggctccggaatatcgtctgggtccggccgttcgccgtcacagaacagcagaaagatatagatgtacgtctatatcctgaggacaatggtgagattacatttgaaatctgccgggaccctgaaagcgcagaggagtcgccgattgtatatgggcaagggagtgcagtgctttgtgaggctggtgaaaatccggtcatcaacattgaagaactgaaggcaagctataatggccggacgctgtcaccttttgattgctacgaggcttatacagaaatgggtattcattatggtgacagccacagagcgatcgacagcctatatgccggcgaaaacggagttctagtgaaattgacgatgcctcctgtaatctctgatacagaagaccattatattctgcatccgagcatgatagattcggcatttcaagcatctatcggtttgaggctgggaggagctacgagtttagaagacagaaaggcaatgctgccttttgccatacaggatgtccaaatcttcaaaggctgcgaggcatctatgtgggcgcggatcacatatagcgagggcagtacagctggggatcgtatgcagaagcttgatatcgatttatgcaatgaagaggggcaggtttgcgtgcgattgacgggctattctgcaagagtgttagaaatagatcaagaaggtccttctgaagcgactgacacgctattgttcgaacatatttgggaagaacgtgctacagagaggcaagagctcatagagtacgacacacataaagtcgttgtctgtgatgttggagaacaaatggaaagcctccaaaatcatcttgactgtacagttctgcagcatgatacagagacaattgatgaacggtttgaaggttatgccatacagttatttgaagaaatcaaacagctaatgcactcaaaaacagggggacatacattcattcaagtggcggtgcctgcgttggacgagcctcagctattaagcggcttaactggattgctcaaaacggctgaactggaaaatccaaaactgacaggacagttgatcgaaatagaaaccgggatgtcagctggtgacctattcgaaatattggaggaaaacagacgctatccgcgtgacacgcatatccggcactggcaagggaagcgatttgtaagcaagtggaaagaagtgtctggtgagcacctaagtgctgacatgccatggaaggataaaggcgtgtatctgatcacaggcggtgcgggcggtcttggattcatctttgcaactgaaattgcaaaccaaacgaatgatgcggttgtgatcctgacaggacgctctccgcttgatgaaaggaagaagaagaagcttaaagccttacagaaacttggcatccaagcgatttacagacaagctgatctggctgacaaacaaacggttgatgccttattaaaagaaacccaaaacgtttatggagacttagatggcatcattcacagcgccggtttaataaaagataatttcattatgaagaaaaagaaagaagaggttcaaaccgttcttgctccaaaggtagcaggactgattcaccttgacgaagcaacgaaagatattccgctcgatttctttatccttttttcctcaggtgccggagcagtaggaagcgcgggacaggctgattacgcaatggccaatgcatttatgaatgcattcagcgaatatcgcaatggccaagcagagctgcacaagcgttacggaaaaactctttcagtgtgctggccgctgtggaaagacgggggcatgcaaattgatgcggaaactgcaaggatgctgaaaagagaaacaggcatggtggccatggaaacagatcgtgggattcaggcgctatatcatggctggacgtcaggaaagccgcaagtgttagttgcttccggtgttactgatcggattcgtgcatttttacatgaaacgggacatggcaaaggccaatctcacgatatcaaaaaaagcagtctcaatcaggaggcagaaaaagcagacatgatcggggaaattgatgaagaaatactaagagaaaaagcggagaactattttaaacaggtgctttcttcggtgattaagctgccagccggccagattgatgctgaagctcctctcgaggattacgggatcgattctatcatgatcatgcatgtaacgggtcaattagaaaaagtattcggttctttgtccaagacgttgttctttgaatatcaggatattcgctcattaacacggtattttattggttcccgcagagaaaaactgctggacatcttgggaattgaaacaggaaaaccttctgttgaaagaaaatcagaacctgaaaaacaagaaatcccagttaccctaagaaagtctggatttcttcctttgcgagataaagagcagaagcagttaagagagaaggaaacggaagaaatcgcgatcatcggtatctcaggtcgctatccacaggcagacaacattgatgaattgtgggaaaacctgagagacggtcgagactgtattactgaaattcctgcagaccgctgggatcacagtctttattatgatgaagataaagacaagcctggaaaaacctacagcaagtggggaggcttcttgaaggatgtagacaagtttgatcctcagtttttccatatatcgccgcgtgaggcaaaatttatggacccgcaagagcgtttatttttgcagtgcgtgtatgaaacgatggaagacgcaggctatacaagagagcacctcggccgtaagcgtgatgctgagcttggcggaagcgtcggtgtttacgtcggtgtcatgtacgaagaatatcagctgtacggggcacaagagcaggtgcggggaaggtctctggctttaacgggaaatccatcatccatcgcgaaccgggtatcttattattttgattttcacggaccgagtattgctttagacaccatgtgttcttcttctttaacggctatccacttggcctgccaaagcctgcagcgcggagagtgtgaggcggcattcgcgggcggcgtgaatgtgtcaatccatccaaataaatatttgatgctcgggcagaacaaatttatgtccagcaaaggccgatgtgaaagcttcggacagggcggagacggctatgtgccgggggaaggcgttggagcagtgcttttgaagccattgtctaaagcagttgaagatggtgatcacatttatggaatcattaaggggacagccatcaaccacgggggaaaaacaaacgggtactcagtgcccaatccgaatgcccaagcagatgtcatcaaaaaggcgtttgtggaagcgaaggttgatccgcggacagtcagttacatcgaagcccacggcacgggaacctctctcggtgatcctattgaaatcacagggctgtccaaagtgtttacgcaagaaaccgatgacaaacaattttgtgcaatagggtcagccaaatcaaatatcgggcactgtgagagtgcggcaggtatcgcaggagtaacgaaggtattgctccaaatgaaatacaggcagcttgcgccttccctgcattcaaacgtgctgaacccgaatattgatttccttaactcgccgtttaaagtacagcaagagctagaagagtggaagaggccgatcatcagtgtcaatggcaaagacatcgaattaccgagaatcgcaggagtctcttcatttggtgccggaggtgtgaacgcccatattttaatagaagagtatgctccggaacctgtggaggaacgtttaccagcgaggaaacagccggctgtcattgtgctctcagcaaaaaatgaggaaagacttcagaaacgcgcggagcgattgctgcatgccattcgtgaacaaacatatgttgaagcagatttacaccgaattgcctatacgctgcaagtcggccgggaagcgatgaacgaacggctggcgttcgttgcggaaacgatgcaggagcttgaagaaaagctgtatgaatgtatctccggaacagaaaatcgtgaatatgtctatcgcggacaagtaaagagcaacaaagaagccattgctgcttttgctgctgatgaggatatgtcaaaaacaattgaggcatggctgcaaaaaggaaaatatgcgaaggttttagacctgtgggtaagaggtttgcgaatcgactggagcacgctatatcaggatcaaaaaccgcggcgcatcagtttacctgcctatcctttctcaagagatcgctattggatagacgtacatgcaaaggctgaggtaaaaagaacggaggagccattcgctccagtacagcccgttattccaaagccgtctgtagacagagaagccagcggcaagcctgccaatattacgttacagcctttaatgaccaatcaggatcgtttggagcggacagcatctctggttccatcagatacagaaacagagacgatcacggcggagaccttgtgcgatgaactgacagcgagcttagcggaagtgctgtacatggaccaaaacgagattgatccagacgaagcattcatagatatcggtatggactcgattaccgggctcgaatggataaaagcaataaataaacagtatggcacatcactaaatgtcacaaaggtatatgattatccgaccacacgtgatttcgctgtttacttagcacacgagttaagcacacaagctggggagaaaaaacaaacggagacgtacacgccgatcagacaaaaaacagcggtacctgctgctaaaccggctaatatatctctgcagccgttagaacatcatcagccagtgcaagaggaagctgaagaaacgattcaatatgcagcggcagaaatatctgcatcaagacaatatgctgtagcaattgaaacgctgcatgaaaacttgagggaaagcatagcagacgtgttatacatggagccatacgaggtggatattgacgaagcgttcatagatatcggaatggactcgattaccggactcgaatggataaaagcggtgaacaagcaatacggaacgtcttttacggtaaccagggtatatgattatccaacgatacgtgattttgctgaaatgctaaagtccgagcttggaactcatcttgatagaaagatagagcatactgactctttcgaagcagcccagcaaaagccagcagcaccatctcatccaaagctggcagaacggccccttcagcctgttcaacatccaataaagaaagaacatgagaagaaaacggttcctgttcatcaagaccgcccggaggatgcgatagcgattgtcgggatgtcgggaagatatccgggcgctcgtaatgtaagagggtactgggataacctggttcatgcgagaaatgccattcgggacattccaacatcacggtgggatgttgacaaatactatgatcctgtcctcaacaaaaaagggaaagtctattgcaaatcaatggggatgcttgatgatattgaacattttgatccgttgttttttaatattccgccgtcagaagctgaactgatggacccgcagcatcgaatctttttgcaggaaggctataaagcctttgaggacgctgggtacaacgcccgaactttaaatgagaaaaaatgcggtgtatatctcggcattatgagcaatgaatacggggtcatgctgaaccggcaggcaagagcaaatgccaccgggaacagctttgcgatcgctgcggcgcgtattccatattttcttaatttaaaagggcctgcgattcctattgacaccgcttgttcatcttcattggtcggcacacatttagcgcggcaggcacttataaacaaagaaattgatatggcgctggtcggcggggtcagcttatacctgacgccggaatcttacatcagtatgtgtgaggccggcatgctttcacctgatggacaatgtaaagcatttgacaatggcgcgaatggttttgtgcccggcgagggtgcgggtgcgctggttctgaaaaggctgaaagatgcggaagcggaccgtgaccatatttatggcatcatcattggctcgggtattaatcaggacgggaaaacaaacggaatcacggcaccgagtgcgaaaagccaaatggatctggaaagagacatatatgaaacatacggcatacatcctgagagtatcagttatgtcgagatgcacggcacaggaacaaaacaaggcgatccaattgaattagaagctctgtccaccgtatttcaagaaaaaacagacaaaaagcagttttgtgcaatcggttccgtcaaaagcaatattggccatacatccgcggcggcaggagtagccggggttcaaaaagtgttattgtgcatgaatcataaaacacttgtgccgacattgaacttcacgacaccgaatgagcattttgaatttgagcattctcctttatacgtaaatacggagcttaagccttgggaaacgactgatggaaaaccgcggagagcatgtgtgagctctttcggatatagcggaacgaatgcccatattgtgatagaggaatatcagcctgacaagaggaacgatcgattaacaaagcagcaccgctcagcattatttgcactctcagcgaaaaaagagaagcaattgaaggcctatgcggaagcaatgaaagatttcgtaacttccaatgaagatatcgatctggaggatatggcatacacacttcagacgggccgggaagcaatggattatcggcttgcgtttttgacggattcgagagaaatgctgatcaaaactttagatgattatttggctgagaagccgaacagcagcatatttgctgctcacgtgaaaacgaagaagagcgaaatcaagctgtttgaaacggatcatgatgccaaagcattgctgcaaacatggatagagaaaaaaaggctggagaaagtagcagagctatgggtgaaagggctgcagatagattggaacaagctttatggggaatacacgcctcgccgaatcagcctgcctgcttatccgttcgcggaagagtattactggctgccaactcaagaaggtgaacccgaaaccattgctacagcactccctcattccgaactgatgccaaagcgctgctttctgcgtaaacagtggcagccttgtccgattgaaccggcagaaatgacgaatcaaaccgtcgccattttggcaaatgaggagacaatggcattagcggaagagctttcgacgtatttctcgacataccgtatatttgacatccaagagctggagcgggtatctgctgctgactatgaacacgttgctggagcaatcgatctgatcgggtgcggaacgagccatgagcattctatgggctggataaactggctccaaaagctgatcgagcaaggacgtgcaagcaagcatcatttgacggtcttgggtgtaacaaaggggctggaggcctacgcaaatgagggtgttcttttgtctggtgcttcacgggccggtttataccgcatgcttcaaagtgagtacagccatcttacttcaagacatgcagatatggaatgcgaagcctcttttgaggagctggccagactgattgcagcggagttttatgccaagagcacagaagcagaagtctgttatcgaaacggacagcgatatcgagcatatttggcagagcagccagcagaagccgctctaagtcataagcaagtatcgttttcaacagacaaagtcctgctcattacaggcgggacaagaggtctcggcttgctgtgtgcgcggcattttgtgaaaacatacggcgttaagcggctggtccttatcggccgtgaagagcttccgccgcgtgaccagtggaattcggtaaaaatttcctcgcttgccgagaaaataaaagccgttcaagagctagaagacatgggtgcgcaagttcaggtgctgtctctggatctcacagacagggttgctgtcgaacagagcctgaagacaatacacgaaacaatgggggcgattggcggagtcatccattgtgccgggatggtgaacaaacaaaacccggcttttatcagaaaatcacgagaagagatcggacaggtgcttgaaccgaaagtcgaaggtctgcaaacgttgtttgacctgcttcaggatgaaccattggcgtttttcaccttgttttcatcagtatcagcggccatccctgcactagcagcaggacaagctgattacgcgatggcaaatgcttttatggattattttgcggaggctcatcaagataaatgtcccattgtaagcattcagtggcctaactggaaggagaccggtttaggcgaggttcgaagcaaagctttagaacaaactggattgatcagtttgacaaacgacgagggattacagctgcttgaccagattctatcagacagacagtatgctgtcgtgctgccggcagtaccagatacaaacgtttggaagccggataagctgatgcagccgtcactgcctgtcgaagctctctcgcatcctgagacgaaagagcaaaccggcactcgcaacctgttccctgaaacagtcgactggctcgtaactcttttttcagatgaactgaaaatagctgcagaagactttgaaacggatgaacctttccaagaatacggaatcgactcgattatattggcccagctggtacagcagatgaaccaacaattaaatggagatattgatccgtcaattttgtttgaatacccgacaatagaatcctttgcacactggctcatttcgaaatatgacatatcagctgttttacagccatctgtttctgagaaacagacacctgtcaagccgcaatcagcaatgaaacagaagccggtgccagaacagcggccgcaacagataagccatgaaaaaacggcacttcttgctgaggacatcgctatcatcggtcttagttgcaggttcccgggagcggaaaccctagaggaatactgggaactaatacgtgatggacggtctgcgattgcgcctgttccgcctgaacgattcgggaactccagctcgaattacgcgggcctcattgatgaaatgaaccgatttgatcatgatttcttcatgatgtccgaaagcgatgtcagagcgatggaccctcaagctttggctgtattggaggaaagcttgaagctgtggtatcacgcgggttatacagagaaagaagtgaaaggcatgagggctggtgtttatataggaggccgcagccagcacaagcctgatccggccagtctttcaaaagcaaaaaatccgatagtcgctggcggacaaaactatttagcagctaacatctcacaattttttgacttgaagggaccgagtattgtcctggataccgcttgttcctctgcactggtggggctgaatatggccattcaggctctgcgaagcggagatattgaggcagcggttgtaggcggcgtcagtttgcttgatgctgatgcgcatcgaatgtttcatgagcgcggacttttatgtgacaagccgtcattccatatttttgataagcgggcagacggtgtcattttaggagaaggcgtgggcatggttctcgtcaaaaccgtcagccaagcgcttgaagacggagattccatatatgcagtcattaaggctgctgcgattaataatgatggaagaacggctggcccatcatctccgaatctcgaggcacaaaaggacgtcatgctgtcagcgcttgaaaaaagcggcaaaaagactgaagagatcagctatctcgaagcgaacggctcggggtcggcagtaacagatttacttgaattaaaggcaatccagtccatttaccgttctgaatcaaaggctccgttagggctgggatcggtgaaacctaacatcggccatccattatgtgcagaggggattgcgagcctgattaaagtagctctaatgctgaagcatagacaattggttccgttcctgtcaggtaatgaaaatatgccgtattttgatatagaaaaaacagatttgtatttcagcagatcgcaagccgagtggaaggagacaacgccggctgcggctattaattgttttgcagatggcggaacgaacgcccatctcattatagaagcctggaatgaatcggttgctcgtccaattagaagaaaacctctgcctttgccggaattaaataggcagcccgttttaatcaaaccatcagctcaaaacgtgcaggaaaaagtgcattcagacacaggggcttctaaagatatgttttggaaaactttcaaataagagaggagtgggaaaatgataactgaacaactgcacatttcattaaataatccaatcatgtccaaccacaaggtatatggacaagcgttattacccggccttgcttatatagatttaatctaccaagtattccaggaacatggttatgcataccaagagcttgaattaaaaaacctgaccattttttaccctttgatcgcagatgagtcatatgacattgccctgaccattcacgtgtctgaaagaaaggaagggacatggtccatcatcatcgacggacaaaaacagcatggagaatcactatctgacaagagacaatatgtgactgctgacatgcatcgtaaagagcaaaccgcttttgccgaatcaatagaccttaatcagtggaaaagtacagctgacaggattctgaatttagatgaaatctatgaacaatgccgatctcaagagttagtgcataccggcatgatgaaggcggaaggacagatttatgaagccaaagagggggctttaattgatttagcagttggacaggaagcgttgcgtcattctgatgcttttctgtttcatccgacgcttattgacggcagcggcataggttcaagctgcctgatctcagatcaaacgatgtacctgccattgtattatgaatcgttttctgcttcagaacgattgcaaaaaggatgtacagcacggatcctctcctcatctgtgcaccaaaagaaagaactcacttatatgacgattgaatattttaattcagcaggacaaaaagtggccgagctgaaacaatttgcaggcaaatctgtacggaatgggtcagcctttcattccgcaaaagaaattcaagaagaaagagctgctgtctctcagaacatcagtcaggactatcccgcatttgaaatgtatttgcgtcagttgcttgctaagcagcttgaaaggccggcagaacaaatggatatccacgctgggtactatgagcttggtctggattctccgtcattgcttaccgtggttcaggaaattggagataaggttggagcggatcttgctccgacactgctgtttgaatttacaacaattgcagaactagctgctcatcttgctgctcactattcaattggagaggcggacgatgctgtccgccaatctccttcaccaatgaaggattctcctgatggtgttacctcttcaccagagatcggggaggacattgccattatcggaatggcgggacgctatcctaaggcaaaaacaatacaggaattttgggaacatcttaaagcgggtaccgactgcatcacagagattccaaactcacgctgggagtggaaagaaaacaatggactggattcacctgcaggcaagccactctcgaaatggggcgggtttatcgaggaggctgattgctttgatcctcaatttttcagaatctctccgcgtgaagcggaaatgatggaccctcaggaacggttatttttagagacatgctgggaagctattgaagatgcgggttatacaccagagaaaattgcttcaccgcagggagaaaataaaagacagcatgtcggtgtgtttgccggcgtaatgcataaggactattcccttataggggctgaagctctatcagaacacaatccatttcctttatcgctgaattatgcgcaaatcgccaacagggtctcttactattgtaatttccacggcccaagcatggcggtggacacggtctgctcttcctcattaactgcggttcatctggcaatagagagcatccggaatggagaatgcgaggccgcgcttgccggaggcgtcaatttgtcattgcatccggctaaatatatcagctatggcagtgtaggaatgcactcaagtgacggctattgccatactttcggcaaagacggagatggctacgtatctggagaaggtgtcgggacagtattgctaaaaccgctgcgaaaagctgaacaggacggtgaccgaatctatgctgtcatcaaaggaagtgcgataaatcatgtaggaaaagtaagcggaattacagtaccgagcccggtagctcaagctgatgttatcgaagcgtgtctagaaaaaacaggaattgatccgcgcaccatcagctatgttgaagcccatggcactggcacctcattgggagatccgattgaaatacaggggttagtaaaagctttcagccgcaatacgcaggacaagcaattctgttcaatcggttctgttaaatcgaatattggccatgctgaagctgcagccggcattagcggcttaacgaagactgtcctgcagctgcatcataaaaccttggtgccgtcattacattcagaagagctgaatccttatttgaagcttgatcaaaccccattttttgtccagcatgaaacaaaggaatgggagcagccatcttttacagaaaacggggtggacgtcacatatccccgccgtgctggtttaagttcgtttggcgcttcaggatcaaatgcgcatcttattttggaagaatatattccggccgagagccattctgaaacgattttaacgaaaaatgaagaaatagtgatacctttgtctgcgagaaacaaagatcgtctgcaggcttacgctcttaaacttcttgattttcttagcgaggacgtcaatcttttagcgttagcttatactatgcaggcaggacgggttgaaatggaggagcgtgcggccttcattgtaaaagacataaaagatttaacggctaaacttcgggcgtttgccaatggagaagaagagatcgagggctgctggaccggacgagccaaggagaatcaggaggcggctgggctagcatcggtaaatgcgctgaataacaatttgataacagacagtgaaatgatggaaatggcgaaagcatgggttcaaggaaagcgggtcacctgggacgacctatacggcgatcgcaagccgcttaagatcagtgttccgacctatccgtttgcaagggagcgctactggatcccggttcctgaaatgaaaaccagcactgtgaatcatatcttacatccgctggtgcaccgcaatacatcagactttactgagcagcgctttagctctgtatttacaggtgcggaatttttcctttctgatcatgttgtacagggacagaagattttgccgggcgttgcctatttagagatggcaagggaagcagcggaaaaagctgcaggcgatctggacggcgaacaaagagtggtgtcgcttaaagacattgtgtgggtgcgtcctatcacgatagaaagtgaaccaaaagaaatacatattggcctttttcctgaggataacggggacatttcctttgacatttatagcagctctgaacataaagaagaagccctgacgatacactgccaaggccgcgctgtcatttcagatgaagcggacacttccattttaaacctttcatcaatacagacagaatgcagtttggacacagtgacgtcagaacaatgctatgcagcgtttcgaaagattgggcttgactatggagagggctatcaagggattgaaaaagtctatgtcggcaaagatcaattgcttgcaaaaatctcgttacccgcttttctaaaaaacgacaagcagcattttacgctccacccgagtttgatggattccgcgttccatgccacagtcggttttatcgttaactcagtcaatgccgctggacaagctcagacgctgtctcttccatttgcgttgcaggaggttgatattttcagcccatgtccagagaatatatggtcttatattcgatatagttcagacagtaaagcggaggacaaagtcagaaagtatgatattgatttatgtgatgagaacggacacgtttgtgtgcgaatgaagggtgcctcgatgcgggcacttgatggagagcagcactcaatgccgcaactatcaactgattctcagatgaccgggcatacgatgatgatccctgtctgggaaccggtttcttcagatacggaggataatgcttcgtttgctggtacacgagctgttttatgcggtgctgctgaagctgatcgggcattcataaagcatcattatccgcaagtttcctttatcgatatccggcctgcagatgacattgagggaatagcggtcaaactgcaagcgtacggaagcattgaccatgtattgtggattgccccgtcacatcggggaagtatagatagtgatggacaaggagaagctgttcttcacttatttaagcttgtgaaagcttgcctgcaattaggctatggcgagaaacaacttgaatggtctcttgtgaccgtccaagcgcagccggttacgcaacatgaggcagtacaacccgcccatgcaagcattcatgggcttgccggcacaatggcaaaggaatatccacactggaaaatccgtcttctcgatcttgaaaaaggctgcacatggccggtaaatcacatgtttgcgctcccagctgaccgccttggccatgcttgggcctatcgtaatcagcaatggcatcagcagcaattgatcccatatcggcactcactgtcaggcgacacgctatatcggaaaggcggagtctatgtggtcatcggaggagccgggtatatcggagaggcgtggagtgagtacatgatccgccgctaccaggcgcaaatcgtttggattgggcgaagtcaacttaatgctgccatccagtcaaaaatagaccgactttcggcgcttggccctgagcctttctacattgcagccgatgcagccgataagcattcattgcagcaggcttatgaacaagtgaaaatgcgccatcctcatattcacgggattgttcactctgcgatggttttatttgagcaaagcctggaaaaaatgaagccggaagaattcaccgctggactggcggcgaagatcgatgtcagtattcggatggcccaagtgttccgccaggagaatgtagattttgttttattcttctcttcgcttgtagcccatatcaaaaatgtgaagcaaagccattatgcctctggctgtacatttgcagatgcttttgctcaccagctttctcagagctgggcatgccctgtaaaagtcatgaactgggggtattggggaatagtgaagcggctgaggatgaacattatgtacagctcatgaatcaaatcggcttaggtttaattgagcctgcggaggctatgaaggcgctggaagcactgctttctgggccagtcagccaaacagctttcattcatacgacaaagcctgtagcagtcgaaggcgtgaatcagaatgaattcatcactctttatccagagcaaccttcagcagatgcagagagcctgatggagcgtctgccgactacgggacgatttcaaagagtgacacatgaagagcttgatgatcttctttacaggctgttgttaggacagctgcaaacagccgggctgtttgatggttatacattatcggttgaacgtcttcaacaatataagactcgtgaattttatggaaaatggattcggcaaagcagcgaatttctcttgcagcatggctatcttaagaaagttggagattcattggtgaggaaggaccaagcagaggatatcgagctgctttggctagaatggaacgcgaaaaaagaaaagtggcttaaagacagcgagacaaaggcgatcgttgtattagcagaggccatgctgaaagcattaccggatattttgacagggaaagtccctgcaacagatatcatgttcccgcattcctcgatggaacttgtggaaggcatttataagcataaccaagtggcagactattttaataaagtgcttgccgatacattaatagcttatctggatgaacgtctgaagcacgaccctgaggcatcgattcgcattatggaaataggcgcaggcacaggcggcacgagtgccggaatctttgaaaaactgaaaccatatcaaaagcacatcaatgaatattgctatacagatctgtctaaagcatttttgctgcatgcagaaaaggaatatggggcggaaaatccgtacctgacatatcagctttttgatgtggaaaaaccgattgatcagcaggaatttgaagcgggaggctatgatgtcgtcattgccgctaatgtccttcacgcaacaaaaaatatccgtcaaacactgcggcatacaaaagcggtaatgaaaaacaacggaatgctgctgctgaatgaaatggcgggaaacagcctgttccctcacatcacctttggtcttttggaaggctggtggctgtatgaagatcctgcagtgcggattcccggctgtccaggcttacatcctgacagctggaaagcggcacttgaaagcgaaggctttgaatctgtctttttcccggctgaggcggcacatgatctgagtcaccaaatcgtcgcagcctcaagcaacgggctggttcgccgtatgatgaaaaatgtgatcttgccggagaaggttgtttcacaagcgtctaatcaggagccatcctacattcataccatagattcagaggaagctggacaatcaaaacatgctctcctaagagaaaaaagcacagaatatatgaaaaaactaatcggggaaacgttgaaaattcctgcaagcaaaattgagtcagctgaaccgcttgaaaagtacgggattgattctatcgtcgttgtccagctgacaaatacattacgtaaagaatttgaccatgtaagcagcactttatttttcgagtaccagaccattgacgcattagttgatcatttcatcaaaacaaaaacagaagcgctgatgaaattaacaggtcttgaccgtcaagttcaacaacagacaccggccgaaagcagaacccaatcctcacagaaacctgatcaggccgctaaaagaacacggcgctatcgcaagcttggcttcagcggggagaaagaaacaccgacaaacactcttgcaagtcgtgacgttgccattatcggcatttctggacgctatcctcaggcggaaacagcagaagacttttggaacaacctaaaagaaggaagaaattgtattgaggaaattccgaaagatcgctgggattggaaagcttattacgataaagaaaaaggaaaagaaggatcaatttatacgaaatggggcggatttatcaaggatatggacaagtttgacccattattctttcagatttctccgcttgaggcagaaagaatggaccctcaggagcgattatttctgcaaaccgcttatgcaagtattgaagatgcgggatacacgcctgactcgctctgttcaagcagaaaaatcggcgtctttgccggagtcatgaacaaaaattatccgaccggctacggctattggtctatcgccaacagaatatcctatttactgaatttccaaggcccgagtcttgcagtcgatacagcctgctcatcctccctgacagcgattcatttagcgctggaaagcatctatagcggatcgagtgattgtgccattgccggcggtgtcaatttagttgtcgacccggttcactatcagaatttatctgtcatgaatatgctctctgctagtgatacatgtaaatcattcggcgatgatgcagatggatttgtcgacggtgaaggcgtaggcgccattgtgttaaagccgctgcagcaagcaatagcggacggtgaccatatttacggtgtgataaaggcaagtgccattaatagcggaggaaaaacaaatggatacacggttccaaatcctcatgcacaggcacaggtgattaaagaagcaatggagcgcgccgacattcctgcccgaaccatcagttatttagaggcgcatggaacaggcactgcattaggagatccgattgagatagcggggttaacaaaagcattcgagaaagatacgcaggagaaacagttttgtgcgatcggctccagcaaatcaaatatcggtcattgtgaaagtgcagccggaattgcagggctgacaaaaatactttttcagtttaaatatggccaaattgcgccatcattgcatgctcagcggttgaatccgaacatcgagttcagccatactccatttgtcgttcagcagcaacttggtgaatggaaacgcccggtgattggcgggcaagaggtgcctaggcgcgctggcttgagcagttttggcgccggagggtccaatgcccatatcatcctggaagaatatattccaagaacgggggcgcaaacgccgaaagaacatcctccagcgctgattgtgctgtcggccaaaaacatggaacgcttgcaagaaaaagcggaacagctgcttacagccatcaaacaaaaaaggtaccgcgaaacagacctgatcaggattgcctataccttgcaaacaggccgtgaagcaatggaggaacggctggcctttatagcggaatcactagaggatcttgagagaaagctgaacgattttatcgaaaacaaagcagacagcctgtatctggatcgcatcgatgataacaaaaaagcgttagcagttttatcagcggatgaggatacggaaaaaatcatagaagcatggatgagaaaggggaaatacacgaaactgctggatctttgggtgaaaggcttgtctttcgactggggcatgctgtacggcacccaaacgcctgtccggatcagtcttccggcatatccatttgcaaaagaacgttactgggcaccaggcgcggcaaaggctccggcgtctatagaacaggatcatgatcagcaaacagaagaacctttcaagattatgacttttcaagaagtgtggaaagaagagccggcgactctcacatcgaaacgtatcaaaacgctcatctgttttctgactgaaagagaaaagcaaaacgcatttgcttcagtcctgaaaaacgttgatcaagacaccaaggtcatttttatatcacagggcgaagtgtacagcaaacagtctgaatatagttaccagattgtgcggcaagaacccgttacttttgaaaaggccttccagagcattaaagaagaacttggagagccagatgcaatcctctatatgtggcctatggaagacaagcgctgtataaaggaccattcctgtattgtttacctattacaaggtatgtccgcagcaaagcttcatccttcacgactgctgctggcaggatgttttgaagatagtcttgaccgaagttatctggaatcatggattggcttcgaacgttcactcgggcttgtccttccgcacacaaaagtaactggaatctttcagcccgcggaacaaggatcgatggatgattggacacgtaatatatgggcagaattacaggcttcagctgaacaaacggttttgtatcagaatctgaaacgatatgtaaatcatattgaacagacaacgatacaaccggacaacagcaaattgaagtctggcggtacttacctgattacaggcggtgtaggagggcttggttatttatttgccaagcatttggccaaaaactatgccgcaaacctgattttgacagggaggtcgccttttaatgatgagaagcaaaagcaaataaaagaattaaaggatctaggcggcgaagcgatgtatgcagaagcagatgtgtctgatcctatcgcaatgggagactgcgtaaaaagagggaaagaccgattcggtgccatcaacggtgttattcatgcagccgggatcgagagcgactctgctatttttgacaaaaagatcgaaagcttccagcgcatcattgaaccgaaaatcaacggcacgatagcgcttgatgaatggcttaaaaatgaagaccttgattttatgtgttatttttcttcttcttctgcggttttaggggattttggatgttgtgattatgcgattggcaacaggtttcagatggcttacgcacaatacagaaatgagctgcataacggtaaaacgtttgtcatcaactggcctgtatggaaggatggcggaatgaagatcggtgatgaaggaacaactggtatgtacctgaaatcaagcggccaacgcttcctagaagccgaggaaggcatccgtatgtttgagcacatcctagctcagcaggatgctcagcatctcgtgatagccggtcagcccagccgtgtcagcagatttttaggaatgactgaaccagctattccagaaccggccactcaagcccctctagcacaagaaaacaaggataaggtaaaaacactaagcattgaaaagcgtttagaacacgacttgaaagagcatattcacacattgcttaagatttcaaaggacaagctgaatttgaacaaaaattgggccgacttcggatttgattcgatctatttggctaaattctcgaatgtgttatcaaagcatttcaacatcgaagtgacaccggctttatttttcggctattcgactttacaagaattgatcggctttttcttaaccgatcataaagagctgattgaagcattttaccgggatgatgcatcagaggcgcaaaagccccctgaagcttatgcagcaattcctgtagctttagaaccggaaaccagtaaacaaagcattcggcaggttcacgatgagcctattgccattatcggcatgagcggcaggttccctcaagctgattcggtccatgagctgtgggataatctgaaaaacggtaaatcgtgtatctctgacattccgggcgaacgccgggactgggggagagctaacagagatccagaaaaagcagtgccaaggtggggtgcatttttgaaggacatagaccggtttgatccgctgttttttcaaatatcgcctaaagaagccgaaagcatggatccgcgccagcgcatttttctagaggaagcatggcacacgtttgaagacgccggctatatgggagatcggataaaaggaaaatcctgcggtgtttatgtaggtgtggaagaaggggaatatgcgcacctaaccggagattcggattacattaacggaacacaaaacgccacattgtctgcgagaatcgcatacgcattggatttaaaagggcctaatatggctttgacagcagcatgttcatctggacttgtggcgattcaccaggcatgttcagctctgcgtcagggggattgtgaaatggctttagcgggcggcgtcagcttgaatatttctcacatgtcttttgaggcgctgacaagggccgaaatgctgtctccgaacggacaatgcaaagtgtttgaccaggatgccaatggtcttgtgccaggtgaagcggtggctgctgttctcttgaaaccattatcaaaggcaattgaagataaagatcatatttatggctgcatcaaggccagcggcgtgaattacgatggcaaaaccaacggcattactgcgccaaatccttttagccaggcagaattgatcgaaaatatttatgaaaaaaatgaaatcaatccgctcgatattcaatatgtgatggcgcacagtaccggctcgaatcttggtgatccgcttgaggtccaagcgttaacgagcgtgttcggcaaatatacgaagcagaagcaattctgtatgatcagctcaattaaacctttaatcggacacacatttgcagcgtcaggaacggttgctttaatcagtatgctgatggctatgaaaaaccagatcattccggccactcatcactgtgaatcggaaaaccagtatattccgtttaaagaaagcccatttgtgctttgcaaagaaaaccgttcgtggatcagaaaaaatcagaagccgaggatgggaacgatcagcacgactggaatcagcggcaccaatgcacatgcagtcattgaagaatacattccggaagatcagccgcccacacagcggcatcaagggtcaccgcaggtcatcgtgctttcagcccaaaatgacgatcggcttcaggatgctgcctgccgcatgattgcgtatctggagcagaatcataacctttctttacctgatgtggcatatacgcttcaggttgggagaaaagccatggaagcaaggctagcgatcgttgcaaacaatcaggagcaattagtgcgaaaattgaaggaatatgtggaagcaatgaagaatggtgggatatcgggccaacagagatccctttatacaggatatacagaagggatattagaagaacaagatgaagcagttctgcaggctctcgcaaaagaaagaaatttggaaaacatcgcggaatgctgggtgaaaggatatcagattccttgggaactccttcatgatggcgatcacgttcgaatggtttctttacctggttatccatttgcaagggagcggtattgggtttcgtcaggcacccagcaatcagtggccgttaaacagcattcacaagatatgaaaacagagattgacgagccgaatggcaaaacccatattcaaaagatcattgttcaatttttagcacgagaattgggcatatctgaggatcgaatcaatttcaaaagaaactttttggattatgggatggattcaattcttggccgaaaattgatgcggcatatcgaaaaaaccacgcagctgaagatggccggtcgggaaatccttgaatgtcagacagtccaagctctatctgaccatttggccttaaaagcggaaaaacaaaatcatagcgcagcagcacatcacataaaggacacgtatacagacgagcaaatcatcggattaatgcaagaggtggcgatagggaaattggattttaagagtgtgcaaaacatcatagaagggagtaaatcgtatgaatcataaagaaattctcgatgccttcagatcaggagaattaaccatttctgaggtggaagaacatcttaaaggcatgaagcggcagttgaaaagcccgctttcagaagggcaaaaagggctgtggatgcttcaaaaaatgtctcctgggatgagtgcatatcatattcctttatgctttcgcttcagcaaaccaatacatgcagagacgttcaagaaagcccttctgtttgtacagagacaatatccggtcttagccagtgtgattcaagaagagaatggcattccatttcaatcggttcagttatcaaaggatctttattttgtggaagaggatatatcagcaatgaaatcagcagatattttgccttttctaaaagaaaaagcaaaagaacctttccagttggaagctggtccgttatggcgcacacatctttttcaacggttagaagaagaatgcattgttcttctaacaattcaccatatcatatttgatggtgtgtcgatgctgacattgatatcggcgctatttgaagcgtatcgacaattgctgaatgggattgagcccttgcagcagccattaacagctgattattacgattttgtcgattgggaaaaacggatgctgactggcagagaaggggaagagcatctcgcttactggaaagaacagttgtctgggagtctgccagttcttgatttgcctgctgaccgtccgcggtcttcagcacgaaaattcaaggggcaagcttataaaagcttgctccctcatcacctgaaaaatcaaattaaatcgtttgcccgcaccaatcatgtgaatgaatcggttgtttttctctccatttacaaagtgttgctgcatcattatacaaaacaaaaggatatcattgttggcgttccgacaatgggtcggcaagaagacagatttgaaaccctaatcggttattttatcaatatgatggctgttcggagcaagaatatcggatctcagccattaacagcatttattcgggaacttcagctgacagtggctgacggcctggatcatgcggcgtttccgttccctgcattggtaagagagctgaatgtagaccgctcggccccggattctccggtttttcaaacagcttttctgtaccaaaacttttttcaggcaacaggcttgcaaaaagtgctcgaaccgtatcaaacgcttggcatcgaatatattgaagacattcggcaagagggtgaatttgagctggcgctcgaaatatatgagcaagaaaatgaaacagtgcttcatcttctgtacaaccctgatttgtatgaactgtcctccattgaaagcatgatggagaactatatgaagctcgcgcaacacatgatggatgacccgtctttgccgcttgaagcctactctttgcgattaaatcaagaacaaactaatttggtggaacaatggaatgcgacagggacaaacatcgcaaatgacaagtgtatacatgaggtgtttgaggaaaaagcgaaacaaacccccgatgcggttgctgtgatgtttgaagacagatcacttacatataaagaagtagatgaaaaaagcacatctgtggcagtctaccttcaacatcagggtgttagacctgaacagcccgttggcatttgtgcagagcgttcgtttgatatgatcatcggaattttaggaatactgaaagctggcggagcgtatgtgccgttagatccaagttttccgcaagaacgattagagtacatgctcaaagacagtcaggcatccattgtcctcacccaacctaacgttcatgataggatcatcggattaactggcagccatgtaaaagcgatcaatatcgagttagcttgccgaaacggttatacagaccagcaaagcagcggtttaaagcgggaagtaaaaccggaacacctcgcttatattatatatacatcgggaagcaccggagagcctaaaggggttatggtagagcatcggagcattatgaataccctgaattttcttgaatctcactatcctgtaacggctgaggatgcatatttattgaagacgaactatgtgtttgatgtatcgatctcagaattattcggatggtttattggagatggccgtctagtgattcttccgcctaatggggagaaatcaccgcagctttgcatggattatattgaaacatataaagtgactcacattaattttgtgccggccatgctgcatgtttttttagaaatggcgaaagacaacaagcgattcacagaggacggtccgctgaagtatatgatggttgcaggtgaagccttccctaaagaattagtgaaaaaggcggtatcgctctttaaaaactgccgtgttgaaaatatatacggaccgacggaagcctccatttacgctgcgtatttcggatgcggaaaaggagatatcgcaagtcaccatacaccgattggaaagcctgtttccaacacgaaaatttatattgtggaccagcatttgaaacctgtcccgatcggaaagcctggtgagctttgcatcgctggagccggcttagcaagaggctattttaaaaagccggggcttacggctgaaaaatttattgataatccctttgaaccagggacgaagctatataaatcgggtgattcagcaaggtggcttcctgacggcaacatagaatacttgggacggattgacagccaagtcaaaatacgcggttttcgcgtcgagctgggcgcaatagaaacaaagctgagtgaatttccgggcattttagatcaggcggtagtggtgaagcagctggagggccatcaacagctcgctgcttattatacagaggaaagcggacatgcctctgccaatccaaaagatttgcgccttcatctaaaatcgagtctgcctgaatatatgataccttcacactttatccgcttagatgagcttccattatcgcccagcggaaaagtgaaccgtaaagaattagaaaaacgcgagatcgtgttcaacagaaggaaaccaaatcacttgcaattaacggaaatagaggatcaggtgctgcgcatttgggaggaaacgctcaaggtcagcggatttgggccggaagacggatttttcgatgcgggcggcgattcgcttctggctgtagctgtggctgaacgaatcaaaaaagaattcgattgtgagtttcatgttactgagctgtttgagttttccacgatccgtgcaatcagtgaatacattttggagatgaaaaactcagatctagccgggacacaaaatgaagatcattatgatatcaaaaaagatagaaaacacctagaacagaagattcccccttattttgatgacagtgttgcgattgtggggatatcttgccagttcccgggtgcgaaaaatcatcatgacttctggaaccacatcaaagaaggcaaagaaagcatacgattcttttctgaagaagagcttcgcgcaaatggagttcccgaagaattgatacagcatcctgactatgtgcctgtgcaatctgtgatcgaagggaaagacttattcgatcccggtttctttcaaatctcgccaaaagatgctgagtatatggaccctcagctccgcctcttattgctgcactcctggaaagcgattgaagatgcaggatatgtggctaaggagattccggcaacaagtgtatatatgtctgcaagcagcaattcatatagaacgttattgccgaaggagacaacagaaggacatgaatcaccggatggctatgtctcatgggttttagcccaaagcggaaccattcccacaatgatctcacataagctcggattaaaagggccaagctattttgttcattctaactgttcttcatcactagtcggtttatatcaagcatacaaaagcctgacatcgggcgaatcacaatatgcgcttgtcggaggcgcaacattgcacgcacaatcagcgatcggctacgtgcaccaaaacgggttgaatttttcaagcgacgggcatgtaaaggcgttcgatgcttcggcggacggaatggccggaggtgaaggcgtagcagtcatcctgctgaaaaaagctgtggatgccgtaaaagacggagaccatatttatgccattatgcgcggaataggcatcaataatgatggggcagagaaggcaggcttctatgcgcctagtgtaaaaggccaaacagaagtgatacagcatgtattggatacaaccaagatccatcctgaaacggtcagttatattgaagcacacgggacgggaacgaaattaggcgatcctattgaaatgtctgctctaaataaagtgtacaagcaatacaccgacaaaacacaattttgcggaattggttcagtgaaaacgaatattggccatttggatacagctgcggggttagccggatgcattaaagttgcgatgagtttataccataatgaacttgcaccgaccatcaactgtacggagccgaatccggatataaagtttgaaagctctcctttttatgttgtccgtgtacgaaaatcgttagagaaacacgcaggtgtccatcgggcggctctgagctcattcggccttggcggaactaacgcccatgcaatatttgagcaatatgaaaacatttctgatgcaggtaccgaaaacgaaggcaatcagccttacatcattcctatatcagcaaaaaatagtgaacggctccaagtatacgcgaaggaaatgctgtcctatatcagtcaagacgagcaaaggcatttctctttaagagatattgcatataccttccaagtcggccgtgaagcaatggataacaggatcgtttttatagtgaacgatctggaagagtggaaacatcagctggaagcttttgtgactggaaagccgctcgcagaaggctgtattcaaggagaaaaaacgagaatgacatccgctgaacagctgcttggaaatgctgaagcagatgatatggcttcatcgcggatatcaaaagaagaattgagaaagcttgccgagatgtgggcaaatggctttcacgttgaatggcgcaggctctatccaaatataaagccacgccgcatcagcttgccgacatacccttttgccgaagaacgatactggcctgaaagcagcaccggcgctatcacaacaattgaaccatctcgtttgcatcctttggtgcaccataatacatcggttctgtcagagcagcgtttcagctccattttcacaggacaagagtattttattgccgagcatatcattaaaggcatggcgattttgccggcggcggtcacgcttgaaatggcaagagccgctatagaacaaggaattggcggattggaggatcatgaaactggaatcaggctgaaaaatgtcgtgtgggttcgcccggttgtagcaggaagtgagccggttcaggtaaatatcggactttacgatgaagatggcggacacattgcttatcggatgtatggtgagccggaatccgctgatgcagaaccagttgtatataaccagggtatagcggaattgattcagttaaagcgagaaaaagcactggatctttctaagatcaagaaacaatgtgatcaaagcagaatggatgctgcctcgttttatgaagggatgatcggcgccgattacggtccaggttacaagagtgtagaggccgtatataaaggtgacggccagctgcttgcaaaattatcactgccagaatctgttgcacatacgttgggcgattatgttcttcatccaagtgtaatggacggggcgttacaggcggctgaatatttgcaaaatgtcgtcagagcggaactttcagacactgaagactttaaggcagcactgccatttgccctggaggaacttgaggtctttcgtcagtgcgtttctgatatgtgggtttatgttcaattcaactcgaaaaacaaaccaggagatttgatacagaaagtcgatattcacctatgcgatgagcatggcatgatctgcgtgcggctgaaaggattttcgacgagggtgatggaggcagatatacaaaccgaaccatcaaaaatgaacgctgaaactttattgcttcagcccgtttggcaagaacaaaaggctgctaacagcttagctgcaaaaaaatatgcagagcatctcgtgttcctctgtgaatatgacaatgagacgagagaacagattgaagcagccatcgaggatgtccatgtatacagcctggaagcaaggccttcttcagtagatgggcgtttccattcttatacagaacaagtgtttaaaaaggtacaagagatcattcgtacgaaaccgaaagacggcattctcgttcagatcgtgacctctgccgagggagaacagcaattgttttcagggttgacaggactgctgaaaacagcttgtcaggaaaatgccaaactaaccggccaaatgattgaagtcagcagtgaagaaagtggaggaagcattgctggcaaactgttagaaaatcaaatgagcagcgattcatatgtcaaatatcaaaacgggacacggtatattgctgattggcgtgaaatcaaacaggcaaaaggagacggcagcaagccgtggaaagacaatggcgtttatctcattacaggaggtgccggcggactaggtcatatttttgcaaaggaaattgcggaacaaacgaaaaatgcgacagtcattctggcgggccgctcacctcttagcgaaagcaaaagcaaaaagctggaagagcttcatagcaagggggctgacatcacctaccggcaaacagatgttaccaataaaattgaagtctatcagctcattgacgacattcaaaaaagatatggccgtctgaacggtatccttcatagtgccggaatcatcaaggacagctacctggttaataaacaggcaaaagatctgcacgatgtactggcgcctaaagtaaaagggcttgtttatctagacgaagcgagcaaggatttgcctttagacttctttattctcttttcatctctttcaggaagtttagggagcattggccagtctgactatgcggcagccaatgtatttatggatatgtatgcaggctatcgaaatcggcttgccgacctcagccagcggcatggaaagacgctttctgtaaactggcctttatggagagatggaggcatgcaggtcgatcaagaaactgagaaaaggcttgtacaacttgccggtattgttcctatgagggcagaaaaaggaattcaggcattatatcaagcacttcattcagaggcaaaccaagtaatggtgatcgaaggcgatgtgcagaaaataaaacaaaacacgctggccaaaaacgcctcagcacctatggaaaagaaggaagcagaacacatgactgaacaaataaatagcattgatacagacagtttgctggataaagtaaaggcgatgttaaagcgagagatcgccaagctgttaaaggtcaagcttgaaacgattgatgatcatgccgagatgacggtgtatggttttgattctatctccatgactgaattcaccaaccatatcaatcgcgcctatcagttagagctgacgccaaccgtattttttgaccacccgacgattcatgcgtttggcaagcatttgtcagaagaatatcaatcggtatttgcgaagacatttgctgtgcgcgctgcatcggctcagcttcagcctgctgcgaaacaggaacaagccgtgcgtgccaaagctaaaagacgcagaaagcagcaagtcatgctgccaaacgccatacagagtgatgcagggcctgagccaattgccattgtgggcataagcgggattttccctatggcgaaagatgttgaggcgtactggaacatcttaaaagagggcaaagactgcatgacggaaatcccgaaagatcgctgggattggcgtaaatatgaaggtgatccggcgaaggaagtcaataaaacgaacgtgaaatggggcggctttattgacggtattgcagattttgatccattattctttggcatttcccgcgtgaagctgaacaaatggaaccacagcagcgcttactgctgacttacgcctggaaagcgatcgaagatgcaggatattcggcgaaaaggttgtcaggcacaaagaccggcgtcttcatcggaacgggaaatacaggatacagctctcttctatctaaagcgaactcggcaatagaaggatcagcggcagccaatacgagcccatcggtcggtccgaaccgggtcagttatttccttaatctgcacgggccgagcgaaccgattgatacagcgtgctcaagttcactagtggcaatccaccatgccatctcttcaattgaagaaggcacttgtgacatggcattagccggcggtgtaaatacgattatccttcctgaggtgtatatcagctttgataaggcgggagcactgagcaaagaaggaaaatgcaagacgttttcaaatcaagccgatggttttgcgcatggggaaggtgccggcatactgttcctgaaaaaattaaaagcggctgaagaagcgggagaccacatttacggagtcataaaaggcagtgcaatcaatcacggcggccgtgcagcctctttaacgactcccaatccgaaggcgcaggcagatgttattcagtcggcatatcaaaaagcgggaatcgatccgaaaaccgtgacctacattgaagcccacggaaccgggacggagcttggagacccggttgaaattaacggtttgaaatcagcttttaaagcattgggtgtaaatgaaggagacacatcagtcaatccttactgcggtttaggttctgtaaagacaaacattggccacttatcgctggcagccggtgcagcaggagttattaaaatattattgcagcttaagcataaaaccttagtgaaaagtctgcattgcgaaaccgtgaatccatacattcagctgaaaaacagtccgttctatatcgtacgggaaacggaagaatggaaagcgctgaaaaatgaacggggagaagagcttcctcgtcgggcaggtgtcagttcatttggaatcggcggggtaaacgcccacgtgattatcgaggaatatattccggaagcatccgatgagaatataccatccatcacgccggaacatccgggtatcttcgttttatcggctaaaaataaagcgcggctaaaagaacatgcacagcagctggcagatgcgcttgataagcaaacatatagtgacgtaaatctcgcccgaatcgcttatacactgcaagccggacgggatgcgatggaagaacgtctcgggattatttccggttccattgaggatttacagcaaaagttaaaagactttgcagcggagaaaagcggtgtggaggatgtatttaaaggcaggattgataaaggcacactccaaatgctgacagaggacgaagagattcaagaagccgtcgagaaatggatggaacggggaaagtatgcaaaattgcttgaattatgggtaaaagggcttgatgtagactggacgaaattgtatggcgagaatctgccaaagcgcatcagcttgccgacgtatcctttcgcaaaagaccgttattggatctctgatcatattgaaaaaagcggcagcattgatgcaaatcaagcagcctcccgccttggcggagccgtgctgcatccattaatgcatcaaaacacatcgaatctctcggaacaaaggtttagctctatttatacgggagaagagtttttccttgctgatcatgttgtgaaaggccaacggattttgccgggagtggctcatcttgaattggcgcgggcagctgttgagcaggccgcagaggtacaaggtgtaccgtgtaccatgaagctaaagaatgcggtgtgggtgcggcctattgttgtagaggatcagccgcagcaagtacacattaggcttttaccgggagaaaatggtgagatctcttatgaaatctatggtcattcagacgttactggcgaacagtcaatcgtctacagtcaaggcagcgcgatattgaatcctgctgaaaatctgccggcggttgatttgcaatctctgcgggagcagtgtcaggaaagccatttcagcgtaaacgaagtatacgacacctatcgaatgattggatttgaatatggtcctgcttatcgcggagtgaaaaaaatctatacagctgaacaatttgttttggcaaaattgtcattgcatccgtcagctgcagatacgctcagccaatacaaaatgcaccctgggctgatggattctgctttgcaggcgtcaagcattttgacaggcgccggggataaccagctgacactgccttttgcggtccaggagcttgaagtcttcggagcatgttcgtcagaaatgtgggtatacgcaagatacagccaaggcagcaaggcaactgataaggtgcaaaagcgcgatattgatattttagatgagagcggcaatgtttgcgtacggatgaaaggattatctttcagagcagcggaaggcggctctggatcggcggaatctgatcaaacgctggaaaccctgatgtttgaagaaaaatgggtgcctaaggattttaaaaaagaaagtcctgagcctcattacgaacggcacattgtcatgctttgtgacatgaatggcctctcaaaagatcgcattgaatcaagattgacaggagcggaatgcatcgttttggagtcattccgcgaaggacctgcagagaggttccaagattatgccgaacaagcgcttgagacggttcagggtcttctcaaaagcagacctcagggcaatgttctgatccagctgcttacctctgcacaaagaaagcagtactcattctcagggctatcggcgctccttaaaactgccggcctggagaataaaaaactaatcggccagacgattgaaatcgatttacatgaaaatattgaaagtgtgatagaaaaactgaaagagaataaaaggcacacagaagatcagcacatcaaatatgaaaaaggcaaacggtacatcaatgatctggatgaaatgcaaatagatgatcgggaaataagcatgccgtggagagataaaggtgtatacctcatcacgggtggcgcaggaggacttgggtttatttttgcaaaagagattgctcgtcaagccgaacagcctgtgctcattctgacaggcagatccgcgttgaatgcggatcagcaggcggagcttaacgaacttcagcaattaggggctcgcgcagaatacaggcaggttgacgtgacacaaaccgaagcagcctccgagcttatcacaagcattacgtctgattacgaagacttgaatggtgtcattcacagcgctgggctgattaaagataactatcttatgagcaaaaccaatgaagagctgacacaagttctcgctccaaaggtgaaagggcttgtgaatgtggatgaggcaaccgagcatcttgcgttagatttctttatcctcttttcttcaatatcaagtgttgccggcagcgcgggacaggccgattatgcaatggctaatgcatttatggacagttatgctgcttatcggaatgcgcttgtaaccgccatgtacaggcacggacaaacgttgtcaatcaattggccgctctggaaagaaggcggcatgcgcgcgaataaagaaattgaaaacatgacgttgaaaaacacaggtgtgactccaatgcggaccgagatcggcattcaagcgctgtataaagctttggcatttggcaaagatcaagtcatcgtcatggaaggaatcaaagacatgatgagggaaaagctgactcaaaagccgtcttctgatgatgtaccaatgaaaacagtgcaagtaccggtgacatctgaagcaagaatggatcaagggaatatgttcgaccacattcaagaagttttaaagcaaacaatctctcaattgctcaaaatcaaacctgaagagattgacccggacatggagtttaatcaatatggatttgattcgattacgttaactgaattcgcaaatacactgaatgagaagtacaagctggatcttacgcctacgatcttctttgagcacgcaactgtttatgcatttgcagggtttctgtcagaagaatatccaaatgcttttacagctcaaacgcctgccaaagctgaggtgctgatgcagcctgtcgaacagaatataaaaaacatgacgttttcgactgaaaaccgctttgtaaaaccttcggtaacaccaatgcaaaaggaagctgatcacaagcctgagcctattgcgattgttgggatgagcggcgttttcccaaaggcaaaagacgttgaggaatattggaagaacctgtcattgggcacggattgtattacagaggttccaaaagaccgctgggattggcaggagtattacggagaccctctgaaagaagcgaataaaacaaacgtcaaatggggcggttttattgatgaagtagctgactttgatccattgttcttcggcatatctccgctggaggctgagcagatggagcctcagcagcgcctgttaatgacctatgcgtggaaggcggtagaagaagcgggacactcagctagaagcctggcaggaaccaaaacgggcatcttcatcgggacaggaaacacagggtacagttcacttctgtcaaatgtagacatcgaaggctcagcggctgcgaatatgagtccttctgcaggaccgaatagagtcagttatttcctgaacattcatggaccgagtgaaccgatcgacactgcgtgctcaagctctttggtcgccattcatcatgcggtttgcgccattgaaaatggaaactgtgaaatggcgattgcgggaggggtcaacacggtcgtaactccgcaaggccatatcgcctatgataaagccggggcgctgagcaaagaaggaagatgcaaaacattttctgacaaagccgatggattcgcagtcagtgaaggtgccggcattctctttctgaaaaagctgacagcggctgaacgagacggtgatcatatttacggtgtcattaaaggaagtgcggtaaaccacggtggccgcgcaaattctctaacgactcctaatccgaaagctcaggcggatgtcgtaaaaacagcatatgaaaaagcgggaattgatccaagaaccgtaacttatattgaagcgcatgggactggaaccgagctgggcgatccagtagaaatcaacggcttaaaagcggcatttaaagagctgtatgaaaaaacgggggacccggctgttcatggcagccattgcggacttgggtcagcgaaaacaaacatcggtcacttatcgctggcggccggtgtggcgggtgtcattaaagtgttattgcagctcaagcataaaacacttgtcaaaagtctgtacagtgaaactgttaatccatatatcagactggatgacagcccgttttatattgtgcaggaatcgagagagtggcaggcgcttcgggatgaagccggccgagagctgccgcgccgcgcaggcatcagttcgttcgggataggcggcgtcaatgcccacgtggtcattgaggaatatattccgaaagaaacaacccatcctgcaacagcaccagctgtgacagcacagcacccgggcatctttattttgtcggcaaaggatgaagatcgtctgaaagaccaagcccggcaattagcagactttatcagcaagcgatctatcactgctcgtgacctcactgatattgcttatacactccaagaggggcgtgatgcaatggaggagagattagggatcatcgctgtctcgactggagacttgctggaaaaactgaacctctttatagaagggggcaccaatgcgaagtacatgtacagaggcagagcagaaaaaggtatcgcacaaacattgagatcagatgacgaagtacagaaaacgctcaacaatagctgggagcctcacatatatgaaagactgcttgatttatgggtaaaaggcatggaaataggctggagtaaactgtatgacggcaaacagccgaaacgcatcagcctccctacctatccatttgcgaaagaacgctactggataacggatacgaaagaggaggcagccgcccatcaaacagctttaaaaacagtcgaatcagcagttttgcatccattgatacatgtcaacacatctgatttgtcagagcagcgtttcagctcggcctttacaggtgctgagttctttttcgccgatcataaggtgaagggaaaaccggttatgccgggcgtggcatatcttgagatggttcatgctgccgttacaagagcagtgagaagaaccgaagatcaacaatccgttattcacatcaaaaatgttgtgtgggtgcagccgattgtggcggacggccagcctgttcaagtggatatcagtctaaatccccagcaggacggcgagattgcttttaacgtctatacagaggctgcacacaatgatcgaaagatacattgtcaaggcagtgcttcaatccgcggggcaggagacattccagtccaggatatcagcgtgcttcaagaccaatgcagtttaagcacactctcacacgaccaatgttatgaattgtttaaggcgatcggcattgactacggacctggttttcaagggatagctcggctttacatcggccgcaatcaagccttggcagagctttctctgcctgctggtgtaactcacacactgaatgaattcgttcttcatccaagtatggccgattctgctttacaagcatcgatcgggctaaagctgaattccggtgacgagcagctttctctgccttttgcgctgcaagagctagaaatattcagcccgtgtacaagtaaaatgtgggtgtctgtgacatctcgtcctaatgaggacaaaatacagagactggatattgatttgtgtgatgaacaaggccgagtgtgtgtaagaatcaaggggattacctcaaggctgctggaagaaggcatacaaccgccagacgggccgacatcactaggaaactccaaagcaactcttaacggagcgcctcttatggcgccgatatgggatcgagtgcagctggagaagaggatcatttcgcctgctgatgagcgtgttgtcatcctcggaggggatgacaacagcagaaaagctgttcaaaggcagatcccatttgccaaggagctgtacattgagccgaacgcatcaattcatagaattgcaggacagcttgaagcactcggatcgtttgaccacatcgtgtggatgtctccttctcgtgtgacagagtgcgaagtcggcgatgaaatgattgaagcccaagatcaaggcgtcattcaaatgtataggctcattaaggcaatgctttctttaggctatggacagaaggagataagctggacggtcgtgacggtgaacacacaatatgttgatcagcatgatattgtcgacccggtcgatgccggggtgcacggcctgatcggttcaatgtcaaaagaatatccaaattggcagacaaagctgttcgatgttaaaaaatacgaagacctgccgttatctcaactcctttccttgcctgccgatcaagaagggaatacgtgggcctatcgaaacaagatttggcataagcttcgtctaattccagtacacaacaatcaaccggtgcacacgaagtataagcacggaggtgtttatgttgtcataggcggagctggtggtattggtgaggcgtggagtgaatatatgatcagaacatatcaggcgcagatcgtttggattggcagaaggaaaaaggatgcagccattcaaagcaagctggacagacttgcacgtctagggccagccccgtattacattcaagcagatgcggctaaccgagaggaattagaacgcgcgtatgaaacaatgaaacaaacgcatcgagaaatcaacggtgtcattcattctgcgattgtcttacaagaccgaagcctgatgaatatgagtgaggaatgtttcagaaacgttcttgctgcaaaagttgatgtaagcgtgcgaatggcccaagttttccggcatgaaccactggattttgttttgtttttctcttccgtacaatcgtttgcaagagcttccggacaaagcaattacgctgcgggctgcagttttaaggatgcttttgcacagcggctatctcaagtatggccttgtacagtggctgtgatgaattggagttattgggggagcattggtgttgtttcatcaccggattaccagaagagaatggctcaggcaggcattggctcaattgaagcccctgaagcaatggaagctttggaattgctgcttgggggaccgctaaagcagctagtgatgatgaaaatggcaaacgaaacgaatgatgaagcggaacagacagacgaaacaattgaagtgtacccggaaactcacggctccgccattcaaaagctgcgaagctatcacccgggtgacagcacaaagattcaacaactgttataggaggggaagcgccaatgctgaacacagaagacattctctgtaaaatgcttttcgcacaattacagtccatagggtttttcacagaaagtaaatcccagccggtattggagaatttctatggcagatggttcgaagaaagccaatcaattttagaacggcagcaatttttgaagcgaacggagaacggatatgttccaacacgctcaataggcaccatgagcgagctttggaaagaatggaatgaacaaaaatctgacctgcttcaagacaataatatgaaagccatggtgacattggtggagacagcacttaaagccttgccggagattctgaccggcaaggcgtcagccaccgatatcctgtttccgaattcatctatggatttagtagaaggggtctataaaaacaatcaagtcgcagactattttaatgatgtgcttgcagatacgttaacagcctatctgcaagaacgtctgaagcaagagcctgaggcgaagattcgaatattagaaatcggagctgggaccggcgggacaagcgcggctgtttttcaaaaattgaaagcatggcagacacatataaaagaatattgttatacagatctgtctaaagcttttttaatgcatgcagaaaataagtatggtcctgacaatccatatttgacatataaacgatttaatgtcgaggagccggcgtctgaacagcatattgatgcgggaggctacgacgcggtcatcgcggcaaatgtgcttcatgccacaaaaaatatccggcaaacattgcgaaatgcaaaagcagttttgaaaaagaacgggctgctccttttaaatgaaataagtaatcataatatatattcgcatttgacgttcggccttttagagggctggtggctgtatgaggaccctgatctccgcataccgggctgtccgggcctgtatccggatacttggaaaacggtgcttgagagtgaaggatttcgctatgtttcctttatggctgaacaatcgcatcagctcggccagcagatcattgccgctgaaagtaacggagtcgtccgtcaaaagaagagaacggggcagaagaagatccaagccatatacaaatgaatgctgaaatcgatcattcacaggaaagcgattctctcatcgaacaaacggcacaatttgtgaagcatacgctggcaaaatcaatcaaactatcaccagaacgtattcacgaagatacgacatttgagaagtatggaattgattcgattttgcaggtgaatttcattcgtgaattagaaaaagtgacgggagagcttccaaaaaccattttatttgaacataacaacacaaaagaactcgtcgaatatttagtaaaggggcatgaaaataagctccggacagcattgttaaaggaaaaaacgaagcctgcaaaaaatgaagctccacttcaaacagagcgtacagatcctaataagccatttacttttcatacacgccgctttgttacagagcaggaagtcactgaaactcagctagcaaataccgaaccactaaaaaaagaaaagacaagtaatttgcaaggaacacattttaatgattctagtacagaagatatcgcaataatcggggtaagcgggcgctatccgatgtctaacagtttagaagagctttgggggcatttaatcgccggagacaattgtattacagaggcaccggaatccagatggcgcacatctttattgaaaacattatcaaaagatccaaaaaagccggcaaataagaaacgctatggcggatttttacaagatatagaggcatttgaccatcagctttttgaggtggagcaaaaccgggtgatggaaatgacaccggaactccgtttatgtttagaaaccgtctgggaaacgtttgaggacggcggctatacgcgaacccggctggataaattgcgggatgatgacggagtaggtgtttttatagggaatatgtataaccagtatttttggaatatcccatctttagagcaggcagtcctcagctcaaatgggggagactggcacattgcaaatcgcgtttcccacttttttaacctgaccggaccgagtatcgctgtcagctcagcatgctctagttcattaaacgccatacatcttgcgtgtgaaagcctgaaattgaaaaactgctcaatggcgattgctggaggcgtcaatttaacactcgatctctctaaatatgattctttggagcgtgccaatctgctgggaagcggcaatcaaagcaaaagttttggcacaggaaacgggcttattcccgggaaggcgtcggagctgtcctgttaaaaccgctttcgaaggcgatggaagatcaggatcatatttacgctgtgatcaaaagcagttttgctaaccatagcggcggaagacagatgtatacagctccagatccgaagcagcaagcaaagttaattgtcaagtcgattcagcagtcgggcattgatccagagactatcggctatattgaatcggcggcaaatggttcggcgctgggcgatcctattgaagtaattgccttaacaaacgcgtttcaacaatatacaaacaagaaacagttttgtgcgataggctctgtcaaatccaatctggggcatttagaggcggcttccggtatttctcagctgacaaaagtgctgctgcagatgaagaaagggacgatggtgccgacaattaacgcgatgcctgtcaatccaaatattaagttggaacacacggctttctatcttcaggaacaaacagagccatggcatcgcttgaatgatcctgaaactggaaaacaattgccacgcagaagcatgatcaattccttcggagcgggggagcctatgccaatcttattatagaagaatatatggagacggcccctgagaaagaacatatcgctccccgccagcaggaattcactgccgttttttcagccaaaacaaaatggagcctgcttagctatctagaaaatatgcaattgtttttagagaaggaagcttctctggatattgaacccgttgtacaggctttacacaggagaaaccataatttagagcatagggctgcatttacagtgacatcgactcaagagctgttcgaaaaactaaaggtgttccgaacatcaagagaaagctcactccagcaaggcatctatacatcattcgatttacagccatgtgcggaatcagcatctagggatagagaaataaacgcagcagagcaatgggtacaaggggcatcgattgcttttaaagaagctgatatagggaaccgaacaggctgggttcatctgcctcactatgcatttgaccataatacatcatttcatttcgatgtatcgtctatcaatgagaaatcgtcagatgttgaagacaatattaatcagccggtcattcaagatcaattcacttatgatgagccttacgttcaaggacacgtcttcaacaatgaacgggtgcttgtcggtgccacatatggcagtctggccattgaagcattttttaacctgttccctgaggaaaacagcggccgtatcagcaaattaagttataccagtccaattgtcatcaaacaaggcgagaccattgaacttcaggcaaagccgctgcaaaaagatcaagtcatagaactgcaaatcatgtatcgcgagccgtcctctggtttgtggaagcctgccgcaatcggacaatgcggaatcggttcttttgagccaaaaaaagtcaatatcgagaacgttaagcattcattaactaagcttcatcacatcgatcagatgtataaaaccggaaacggtcctgaatggggagagttatttaagacaattactcatctttacagagaccacaagtctatactggcaaaaattcgcctgccccaaagcgggctggcaaacgggcaccattacactgtaagcccattgatgacaaacagcgcgtacttggctatcctcagtttcttggagcagtttgacatgacaggcggcttcctgccgtttggaatcaatgatatccagtttacaaagcaaacgataaaagaggattgctggcttttgattacattggttaagaatacaggtgacatgctgctgtttgatgtagatgtgatcaatgagtcgtcagaaacagtgctgcactactcgggctactcgcttaaacagcttcgtatttcgaatcaaagaggaaatcaaaataaggccatcaaagccagcaatctgaaagatcgtatcagaagctatgtaacagataaactggcagtaaacatggccgatccgtcaaaattgtctcttgcaaaagcgcatatcatggattttggaatcgattcttctcaattggtttcattgacaagggagatggaagcagagacaaagatcgaattaaatccgactctgttttttgagtatccgactattcaagagctaatcgacttttttgcggacaaacatgaagcatcatttgctcagctgtttggtgaagctcatcagcaggaagaacgcccagctcaaatcgaaaaccaaatgaaacagattccggcatacgagacgaacacggataaaacaatcgaacacgcagcagacggcatagccattatcggcatgtcgggacagtttccgaaagcaaacagcgtaacggaattttgggataaccttatccaaggaaagaactgtgtctctgaagtgccgaaagaacgctgggactggcgcaaatatgccgcagccgataaggaagggcaatcaagccttcaatggggcggttttatagaaggaataggtgagtttgatcccctgttttttggcatatcgcctaaagaagcggcgaatatggacccacaggagtttctgctcttgatacatgcatggaaggcgatggaagatgcaggcttaacagggcaggttgtatccagccgcccgacaggagtatttgtcgcagccggcaatacggatacagctgtgattccttccctaattccaaaccgtatatcctatgcacttgatgtaaaagggccaagtgaatattgtgaagctgcctgttcctcagctctagtggctttgcacagagctatacaatccattcgaaacggcgaatgtgagcaagccattgtcggggctgtgaatttgctgctttcaccaaaaggctttattggcttcgactcaatgggctatttgagtgagaaaggacaggccaaatcctttcaagcagatgcaaatggctttgtcagaagtgaaggagcgggagttctcatcattaaaccattgcaaaaagccattgaagattctgatcatatttattcggttattaaaggttcaggtgtatcgcatggcggcaggggaatgtcacttcacgcgccaaatccggccggcatgaaggatgcaatgctgaaggcttatcaaggagcacaaattgatcccaaaacggtgacctatatagaagcgcatgggatcgcctctccattggcagacgcgatagaaatagaggcgttaaagtctggctgcagtcagctcgaattggaacttccacaggaagtacgggaggaagcgccatgttatatcagcagcttaaagccgagcatcggacacggtgaactcgtctcaggcatggctgctcttatgaaggtcagcatggcgatgaagcatcaaacaataccaggcctatccggattttcgtctttgaatgaccaggtgtcaataaagggcacccgtttccgagtgactgccgaaaatcagcaatggggggatttaagtgacgatgcaggcaaaaaaattccgcgcagagcgagtatcaacagctatagctttggaggcgtaaatgcgcacgtcattttagaagaatatattcctttaccaaaaccaccggttagtatgagtgagaatggtgcccacattgtagttctttctgcaaagaatcaagacaggctaaaagcaattgttcaacagcagcttgactatgtgaataaacaacaagcactgtcattacaagattatgcttatacactccaaaccggccgagaggaaatggaagatcgcctagcgctcgtcgtccgcagtaaagaagaactggtaatcggcttgcaagcctgcttagcagaaaaaggcgataagccgaagagttctgtacctgtctttagcggaaatgcagaaaatggctcgtcagatatcgaagccttgctggatggtccattaagagaaatggtgatcgagactttgttgtctgaaaacaaccttgaaaagatcgcgttttgctggacaaaaggggtgcaaatcccatgggagaagctttatcaaggaaaagatgcccgcagaataccgttgccaacctatccatttgaaaagagaagctgctggaacggctttcaagcagtagagagtacgccttctgtttcacaggatgagcgtatcaacaacagcagcgatcatcacatattagcaactgtactagggatggatccggatgaactgcagcctcataagccattgcagcagtatggatttgattcaatttcttgcatacagttattacggcaattgcaatcaaaggtggaccctctcattgccttgacggagcttcaagcatgccatactgttcaggacatgatggacttgatcgcaaagaaacagaaggatacatccttacaaaatgatcaagctcgcacgtttccggaattgataccgttaaatgacggcaagcgggggcgccctgtcttttggttccatggcggagtaggaggagttgaaatctatcagcaatttgcacaaaagagccagcgccctttttacggcattcaagccagaggattcatgactgattatgctcctttgcacggaattgaacaaatggcttcctattatatagagatcattcgatccatacagcctgaaggtccttatgatgtaggcggatattccttaggcgggatgattgcatatgaagtcactcgccagctgcaaagccaaggccttgctgtcaaaagcatggtgatgattgactccccatatcgttctgagacaaaagagaatgaggcatctatgaaaacgtcaatgctgcaaacaattaatatgatgctggcatcgattgcgaaacgggaaaagcttacggatgttctcatcagccgtgaagaggtggacataagcttagaggatgaagaattcctgtctgagttgattgacttggcaaaagaacgagggctaaacaaaccagataagcaaatacgtgcgcaggctcagcaaatgatgaaaacacagcgcgcctatgatttggagtcgtacactgttaagtctctccctgatcctgagacggtaaaatgttattatttccgcaacaaaagcaggtctttctttggtgatttagacacttatttcactttatcaaatgaaaaagaaccgtttgatcaagctgcctattgggaggaatgggagcggcaaattccccatttccacctggtggatgtcgattcaagcaaccacttcatgatattaaccgaaccgaaagcgtcaacagccatgttagaattttgcgaaaagctctattcaaacaggggagtagtgaatgcgaatttccttaaggctttccggaagaaacatgaagcgagggaagaaaaagaaacagatgaattggtgaagcgctaaaaacacaaacgccccctcttttaaaagggggcgttttgaatgttattttgaaagagaaacagggagactttctaatcctcttaaaaagacattttttctccattgaatgtcatcaggcgcaaccgcaagttcaatatcaggaaatctcttcaaaagtgcgttaaatgcaatgtggccttccagcctggcaagaggcgctcctaagcagaaatgaatgccaaaaccgaaagaaatatgtctgttaggcgaccgatttatatttaatatttcggggttctcaaaaaaattcgggtcgcgattggccgatccgatccctataaaaatcatgtctcctcttttgatcgaatgccccttatatgtaaagtcttcgatgacccaccgatttgccatcataacgacaggtgaggtgtatcgcagcaattcttcaaccgctgtagcgatcatttcaggatgctgcttgagcttctcacattccttcttgtgctgcagcaatgcgagggtgcctgagccgagtaagttaacagtcgtctcaaggcctgctacaacgagcaagaacagcatcgaatagagctctttttcgcttaacttgctgccgttttcctcagcatgcacaagtttgctgattaaatcgtctcttggctttattcttctgtcatggatcagcttggagatataatctttaaattcacgaagagcctgatttgtcagctctctgttaccttcagaggtatcaaccatcgcattggtccagatttgaaactgtgaccgatcttcttttgggattcccatcaattcagatataacaataaaaggcaaaggggaagcgaaggatttcatgatatccgctttattttctttttccatttcatctaaaagctgttcagcaatttgttcaatgctgccgcgcagattttcaatggttcggggagtaaatgcttgatgaacaagtgatctcaggcgggtatggtcaggtgtgtcttttgccagcatatgatcggatacaaaatcgatatcttcactaacgttgagcattttgatttgttcttggttcatcacattttttacgtctcttgtaattcgattgtcttttaaaaaggccatacaatcatcgtatcgggtaattaaccaggccggatatgtggctccgaaccgttttaattcaaatcggtgaatgggctcttcctctctaaatcgtcctaaaactgaaaaaggattgtgatgaaactctttaccatgcggatgaaacatcaatttttccatttgcattctcctcgcctaatagggtaaatagatgaatcaaattgctgaactagtttacaaaaaacagaatgatttgaaatgtaatcctgtctctaaaactatatatctattttaggagtcattcaatagggtgaagaacgaaaaaagtgaaaaaacggctcgatataaagcagcgcctttgaacgaaagctcaaaggcgctacgctgtattattttgatgaaagtggctttcagctgtgctggatatcaattgtatatactgcacgatctgttatgaccttcaatccttcgttttcttggtgaatatgaatgtcacctaataaaggaatctcataggcattttgcggaagcggtacgtttccgtcctcagtgaatgttgttccttcgccttctaaaacgagctcttctttcgcaacataatcatcaggatgattcgtactgcgtatagccactttttgaaggtggagaacaatctgatccaagtctgatatctcttcatcatgggtcaattcaccttttctaatatcaagcgtctggccgacttttgattccagccattgagaaagctgtttattcgtgtgtgccatcaatattcctccttttgatctacacgatactattcccaattgctgcatcttttacacggaaaagagccgcctcactctttatgtatgaaacaattcgctgttgagagccttgatatagcgtacggcagaacgctggaccgcttcgccggcattttctttgacaactttagaaaaagcattgtaaagccggttgaattgaagcggttttactttggctgctatttcttcaactttggaggcgggaaggggaatgagatttgggtagctgtacataaagctgacccagtttcggtccgccgcaaccgtaatgatatctccggtcaatagacagcctttcccttcattgcccttgctccaatgcaaaacagcaccgcctttaaaatgtccgcccagtcggtaaaggtccagtcccggcttcacgttgagcgtttcccctgaccagaagtgaatgtgattgcttggccttgtcacccattctttatcatcctcatggatatagatcggcgcctgaaacgcttcagcccactcaacttgagtagagtaataatgtggatgagacaaggcgatggcttgaataccgcctaattcgttgatttggtcaattgtcttttggtcaagatatgtcatgcaatcccacagcacattgaagcccttatgctggataagatgagctgtttgtccgatcgcaaactctggttcagttttgatgctgtaaagatgctcttcttcctttttgaggatgttttgaaggtttcctttctcacgcatgtcttcaagggttgtccaactttgtccatcgggatgaatatactgcctttcatcctcgcaaatcagacacgagttgggcggatctacagtctgtgcatgttgcacaccgcatgtgttgcagatataatatggcactttcttcacttccttcatctattttccattattttaccttatgattatgaatattcaaacaaaaaaccggcagttctgctgagagagaattgccggcttttgatgatgtttattggccgggaacggaattttctgcgttgacagcgcccgctccgtacacatttggatcttcatctttccatttgtccgtgccgtttttcaaaagctcttttacttcatcaggggtaagatccgggttgtgctgaagaattaaagctgcgattcctgcgcaaatcggtgttgccatcgaggttcctgacattgtaaagtactgagaccctacacggcttgacttttggagcttatcaatataagaattcggagagcgaagggaaataatattaacacccggcgctaaaatatcgggcttttctttcccatatactgtcgggccgcggcttgagaaggaagcgacagtatcatcatcgctgcttgcagtattgttatcgtcaagcgcacctactgtaatcaccttttcgctcacgcccgggcttgcaatggtctgcgaatcagggcctgagtttccggcagcgacacagacgacaatccctgcgttccacgcttcttcaaccgctctgactaacggatcttcctgttcatgatcatatctaagggcatcgcccccgagcgacatgctaataatatcaatcggttcatcggggttgtcctcattgtattgaatacaccactcaacaccctctataatatctgctaacgttcctgaaccctgcttgtttaatacctttacgccgatgagattggcttccggtgcaggtccgcggtattggccggaagaggatgcgccgctgcttgcaacatcacctgcacagtgtgtgccatgaccattatcatcgtacggctctgttttttgattgaccatgtccgcgaatccgataattctgccttctagatcaggatgcgggtagattcctgtatcgacaacagcgacagtaacaccttttcctgtcagggtttgcccgtttctgacgacttccttcgcatggcttgcttcggttgccgtgtctaaaagcgctttgacttcgcggtttaaatacactttacggatattgctgcattcagagagaagggaatgtaatgctgaaggagtaacctcggcgctgcagcagttgattttgttgaagcggctttttagcttgctgcgtttttctttttgcagcacctctccagccatttgaaagccggtctcgtgacagccttcctcaaattcgataatgactgacattttttttctgttttgcaatttggtttcgaaaaatttatgcaagaagcaaggagtccatttgaagggcttgtaaagctgcaatacggtttcccgtaacggccaatctagcttgtgagcatttgctctcaccatttgtaccatagagtacccaaacatgtattttcctcctattataaggttctctgtatactctatgaacagatgataggtttggtaagtttgtttgtcctctgtaagagacagacaagagtttgtttttctgaatctttcgcattagatacgatagattcagaagctgaggaaatcattggggattgaaaaagaacgtttgttcgtattataatgtgatcatatcaaactgggaaggggagagcaaccgtatgaatttctacttgcaccgatctttggaaagccaaatgccaatcagcattatatatatgaagaaagacggaacgattagtaaaagaacgattattgtgagacagaaaagcaaaacgaaaatcaaagcattttgtttttcgaaacaacagatcagaacatttttattggactctatcctctcctgtgattttgtgagaacaaataagcaaaatctctattctgcaggccggtaacagctgtccgtctcagcaaccgggcagcctgttactaaaaccctccttaaacctatatacatttatttgccaagtgaggttgttcctaccttttttgtctttcctctcaaccttttttcactcttatttgaaatgaaccgctaataaccgtgacaatcaattgattttttgaaaccgggaactttttcactgatgatattgtgtatacaatggtaagataaaacctattggctaaacctcatataatgaaccgcgccattcttatgaaaggagttaaacatgagaagatttttactaaatgtcatattagtcttagccattgtcttgttcttgagatatgttcattactcattggaacctgaaccatcaaatcagcctgatacatattcaaatttcagcagcttggcagagaatgagagcccagccgattacgatatttcatataatgagaaaaaaggaagcaaagtcttaattatgtctccgcatggcggaagaattgaaggcggagtaagtgagcttgtgcgttatttcaataatgaatactctacatacctgtttgaagggttgaagtcccacgataaccaaacgctgcacattacaagcaccaactttgatgagccattggctaaaaagaaaatcaaggagcatcaatatgtggtggcttttcacggatataaaggagagaacaagaatacgcttgtagggggaacagaccgaaagcgagcgaaaatgattgtgagagcccttgagcggagagggttttccgctgagttagcgtcgtctaaaagcggtcttgctggattgaatgccgaaaacattaataaccaaggggaaacggggctaagtatccagctggaaatcagccgtgagcagagagaagcattttttgatgatttttattataaaaatagaaaatacacaaagaacagtgaattttatgcttatgtcagtgcgatcaaaggtgtcctggaaaaagagtattcgtaacaagcagatcagaagacaaaataagagaagatcagtagactgaaataggataaaaaaggaggcaaaacaatggcagatcatcatttttatttaaaagcgaattggccgggtaaccgcaatgatgtcggtacgattgaaagcggaaacctgatcacatcgatttccattcctaaagaaatggatggcccgggagaagggaccaacccagatgaaatgcttctcggggcggcagcgacctgttacattattacacttgcagcgatgatggagagaagcgggctggaaaaagaagacttacagatggagtcagaaggcattgtcgacgtcacaaaaggagtctttacatacaaaaagatcattcaccgtccctctgtcgtgcttaaacatgatgcttcacaagacgacgtcgcattggcgcacaagctttgtaaaaaagcggagtcgtcatgcatgatttcgcgtgcaattcaaggaaatgtcgagctgcagcttgaagcctctgtgaaactgggtggagaataaagaaaacagacggtcactcacagaccgtctgttttttatcttcagcgtgggctttcgattgatttagcacgaccacgcctgcaatgacaagcgtgagaccgaatacaccttttaaactgatggtttcgccaaaaagcaaaaacccgacaattgctgtaagcgcggtaccaacgcccgaccatgttgcatacgcgcttgataagtcaattgtttttaaagaaaagcttagaaacgtaaaagcagaaagaaatccgactatgactccggcaatgggccaggcttgtgtaaatccttctgaaagcttcagcatcgtgctcccaaacacttcagatacaatggcgagagccaaataaagcaatcctctcatcttcatcactcctttactgccaattaagtaacacgacccctgatagtaataaaagaatcccgataagccctttggcattcagatcttccttgaaccattttactccgatcactgtcgtcagcaccgtgcccgccccgctccaagtcgcataggagaggctcaggggaatatggtttaaagtcagggacagcatataaaaggcgagggaatagccaatgacgaccaaagcacttggcttccactttttgaagccatcagatactttcagcatggctgctcctatcgattccgaacatatggcaatcgtgaggaatatatatcctatcaacatcataaattctcctcactatatttttagattagaaaaaaacttcagctagaaaaatagtagtgtatgcctatgtatgagtcaagagattcattttcacacacttaaaaagacccctttttaaggggccttttgcgtttaataataataagggaacggggcatacggataataggggtatccgccataaaaataaggattaaataaagcgcttcctataagcccgcctgcaaggccgccgataaacggtcctccaaaaaatccgaatggccggccaaacccataaccaaatccgggtcttccaaatccgtaaccgaacccgaacggtcttccaaacccaaatggtctcccgaatccgaacggtcttccaaatattcttgtatcttcagggctgaaatgctctaactcgttcatgttttctttcctcctgtaataaagtgtagatgatgcagtgtattcaccctgcccggatttgattgggcgaatcgaggaaaaggaggatgtgaacacattgggcctgtatcagtctgactggtcaaaagcaccgccccacgcacatgcctatcatgtcaaaacaacgagagaacagggccattatcatctcattgaagggtttactcagccggcaaacggatcaaataccgatcagcatacacattactatacagggatcacttcatttgaaaacggccattttcatcggtattacggaatctcagggccggcaattcccttagcagatggcacacattatcatgaaatcgaagaaacgacgtatctggcctacaacgagccgattgagatccagtacggaggggttgtgtacgatcccggagatgacagaagaaaaacgcatcgtcataccctgaaaggaaagacaagggaaattgtcggcaatgagccgcttggctggtagaaggatgtttaccgatgcaaaaaaagggcaaaatggataggtggttgtccatgttgaatgctataatggggggagatttataaaagagagtgatacatattgaataatacgaagcagcccgttgtcattttagtcggaccgacggcagtggggaaaaccaatttaagtattcagctagccaaatccttaaacgcggaaattatcagcggagattcgatgcagatttataaagggatggatattggaacagctaaaattaccgaacaggagatggagggagtgccccatcatctgattgacattttagatccccaagactccttctctaccgccgattatcaaagcttagtaagaaataaaatcagcgagattgcaaatagaggaaagcttccgatgattgtcggcggtacagggctttatatacaatctgtgctttacgattatacatttacggaagaggcaaatgatcccgtgtttcgagagagcatgcaaatggctgctgagcgggaaggcgctgactttcttcatgccaaacttgccgcagcagatcccgaggcagcagctgcgattcatccgaataatacaagaagagtcattcgcgcactggaaattttacatacgtccggaaaaacgatgtcccagcatttgaaggaacaaaaacgagaacttctgtacaatgcagtgttaattggcctgacaatggatagagacacgctttacgaaagaattaatcggcgggtcgatatgatgatggaggcaggccttcttccggaagtgaagcgcttatacgacaagaacgtgagagactgtcaatcaatacaggcgataggctataaagagctgtatgcatattttgacggttttgtgacactttctgatgctgtcgaacagctaaagcagaactcgaggcggtatgcgaaacgccagctgacgtggtttcgcaacaaaatgcaggtcacatggttcgatatgacaccgcctgttgatatggagctgaaaaaaaaggaaattttcacacatatagcaggaaaactcgaactttaatcgaaactgtatgatatagagaatcaaggaggacgaaacatgaaaccgattaatattcaggatcagtttttgaatcaaatccggaaagaaaatacgtatgtcactgtttttttgctgaacggctttcagttgcgtggccaggtgaaaggctttgataactttaccgtattgttggaatcggaaggtaagcagcagcttatatataaacatgcgatctcaacgtttgcgccgcaaaaaaacgtccagcttgaactcgaatagatcaaaaaatgccatgtcaagacatgaggaaaggctgccgggggttcccggcggccatttttaacatgaatccacttttgctccaagctttttgtgtaagctgaccatgccaaggcacggtctttttttatgagaacaacatacggaagtgaaaatggtatattatgtataaaatgaatttgggagtgatcgaccttgtttgaaagtgaagcagaactgagacgaatcaggattgcacttgtatggatagctgtctttttactgttcggggcgtgcgggaatcaagataccattattgaaacagacagcggcaattcagactatgaaacgcctcagcccacctcgtttccacttgaacataaccattttggcgttatggaggacggctatatcaaaatttatgagtataatgagtcccgcaatgaggtaaagctgaagaaagaatacgcggatgatgagcttgaataaaattcacaagcattcgaatttacaaagcggattccagccgctaaactaaatacagacacagatcaaacagagggtgaaaacatgaagcataaagtgatcgtgaatcattgggaagaaatttgcgaagatgattcttgctatgaatacggaacaagtatcattgtgaacggaaaagaattaatcagagaagcgtcaattatcactgctttgaaggcggttttagaagagatcggcgcggatgttgaaatagaagaaacagtagagagcgaaaaatgctgtgatagcttaagaaaaaaaaatctagactactaagcagttttttttcatgttatgataaacatcggctaaaaaacgacaccccgagtaggacgagagatgattctcgttctgctctcttttttgggccctaatgagtctgcccatttgcctgatttgatcaaaatatgaatttttcataaaaacgaatctatatattgtgtttttgctagagggtagtatactatatatagtgttagtgatgagagattcatattttttgataggtcgtgataaaacgtggtacaaatcatatttgattcgaaaacagggaatgttcagcggtttgtgaataaaacaggttttcagcagatacgcaaggtggacgaaatggaccacgtggacactccgtttgttttggtcacctacacgacaaacttcggccaggtaccggcatcaacacaatcatttctcgaaaaatacgcccatctcttattaggagtcgctgcgagcggcaacaaagtatggggcgataactttgcaaaaagcgccgataccatttcaagacaatatcaggtgccgatcttgcacaaatttgaactcagcggcacatctaaagacgttgaattgtttactcaggaggtagaaagagttgtcacaaaatcaagtgccaaaatggatccagttaaataacgaaatcatgatccaaaaagatggaaaattccagtttgataaggataaagaggctgtacatagctattttgtagattatatcaatcaaaacacagtcttctttcacgatttaaaagagaagctggattatttggttgaaaaccaatactacgaagaggaattcttaagcctttattcttttgaagacattaaagaagtgtttaagacagcttacgctaagaagtttcgttttccttccttcatgagtgcgtttaaattctataatgactatgctttgaaaacgaatgacaagaaaaaaatcctcgagcgttatgaggaccggatctcaattgttgcgctgttcttcgctaacggcgacactgagaaagcaaaagaatatgtaaacctgatgatcaatcaagaatatcagccgagcacaccgacatttctgaacgccggcagaaaacgccgcggtgaacttgtgagctgcttcttgctggaagtcaatgattccttaaacgacatttcaagagcgatcgatatctccatgcagctttctaagcttggcggcggggtttctcttaacctgtccaagcttcgcgcgaaaggtgaagccattaaagatgttgagaatgcgacaaaaggcgttgtaggcgtcatgaagcttcttgataacgcgttccgttacgctgaccaaatgggacaaagacaaggatccggcgcagcgtatttaaacattttccaccgcgatatcaatgattttcttgatacgaaaaagatttctgcggatgaagatgtgcgtgtcaaaacgctttcgatcggtgttgtcattccggataagttcgttgagcttgcacgcgaggacaaagcggcttatgtattctacccgcacacgatttataaagagtacggccagcacatggatgagatggacatgaacgaaatgtacgacaagtttgtcgacaaccctcgggtgaaaaaggaaaaaatcaacccgcggaaactgcttgaaaaattggcgatgcttcgttctgaatcaggctatccatacatcatgttccaagataacgtcaataaagtgcatgcgaataaccatatttccaaggtcaaattttctaacctttgctctgaagtgctgcaggcatctcaagtttcttcatacacagactatgatgaagaagatgaaatcggtctggatatttcctgcaacctgggttcgcttaacattctcaatgtcatggagcataaatcaatcgaaaagacagtcaagcttgcgacagactctttaacacacgtttctgaaacaactgacatccgtaatgcgcctgctgtaagacgggcaaacaaagcgatgaaatcaatcggcctcggtgctatgaaccttcacggctaccttgcgcaaaacggcattgcgtatgaaagcccggaagcgcgtgactttgcaaacacgttctttatgatggtgaacttctactccatccagcgttctgcggaaatcgcaaaagagaagggcgaaacgtttgatcaatatgaaggctcaacctatgcgacaggtgaatactttgacaaatacgtttctactgatttctcaccgaaatacgaaaaaatcgccaacctgtttgagggtatgcatatcccgacgacagaggactgggaaaagctaaaagcatttgtcgctgaacacggcatgtatcacagctacagattatgcattgcgccgacaggctctatctcatacgtccaatcaagtacggcgtctgttatgccgattatggaacgcattgaagaacgaacatacggcaactcaaaaacgtactacccaatgcctgggcttgcatctaataactggttcttctataaagaagcctacgatatggacatgttcaaggttgtggatatgatcgccactatccagcagcacattgatcagggaatcagctttacattgttcttaaaagacacaatgacgacccgtgatttaaaccgaatcgatctgtatgcacatcatagaggaattaaaaccatttactatgcaagaacgaaagatactgggcaagacagctgcctttcttgtgttgtttgattaaaggagagtttatagtgacaaaaatttatgacgcagcaaactggtcaaagcatgaagacgattttacccaaatgttctataaccaaaacgtgaaacagttctggcttccggaagagattgctttaaacggcgatctcctcacatggaagtaccttgggaaaaatgagcaggacacttatatgaaggtactggccggacttacgcttcttgatacagagcaggggaatacggggatgccgatcgtggctgaacacgtagatggccaccagcggaaagcggtgctgaactttatggcgatgatggagaacgctgtccatgcgaagtcgtactctaatattttcatgacccttgcaccgactgaaacgattaatgaagtatttgaatgggttaaacaaaataaatatttgcagaaaaaagcgcaaatgattgtcgggctttacaaagccattcaaaaagatgatgaaatttcactgttcaaagcgatggttgcttccgtctatctggaaagcttccttttctacagcggtttctattatccgttatatttctacggacaaggaaaactgatgcaaagcggtgagatcattaacctgatccttcgtgacgaagcgattcacggcgtgtatgtcggtctccttgctcaggaaatttataataaacagacagaagagaaaaaagcagagcttcgtgaatttgcgatcgaccttctgaatcagttatatgaaaatgagcttgagtatacagaggacttgtacgatcaagtcggactctcacacgatgtaaagaaattcatccgctataatgcgaataaagcgctgatgaatcttggatttgatccatacttcgaagaggaagatattaatccgatcgtattaaacggattaaacacaaaaacaaaatcacatgacttcttctctatgaaggggaatggttataaaaaagcgacagttgagccgctcaaagatgatgacttttattttgaagatgaaaaagagcagatataatatctgctcttttcggcttgaaggttcaaatgaggaggacgcagtacccatgggaaaaatggacgaaatgattttagttgccccgcgcgatgatgtgtttaagaaagaaagcttaaccttccagggcgtgtacagtgaagatagcagagtagccgaaatcatggctcagattgaagcggcctatcgtgaaatgagaagaggggacgcagaagaagatccgcgtttcaagcagccgataccttatgtcgtcattaagcgtgaagatgaagtttttctttacgagcggctggctggcggcggtgaatcacgactgcacaacaagctttctctcggctttggcggtcatatgaacgccatcgaaggggcagcttcatttgctgaagtcttaaagctgaacacagaccgtgagcttgaggaagaactgcaaataaatgaagaagataaacaggcgattgtcacactgggattgatcaatgatgatgaaaacagtgttggcaaagtgcatatcggtattctttctgcgcttcaattaaagcctggcgcacaagtggaagtgaaggagaaagaacaaattgcgggtaaatggatgaaagtttctgaattaaaacaggatgacatctataaccgtctggaaacatggtcacagtttgttgttgatattcttgaataaaaagacccggtttctcgcgatgaggagccgggtttttttatgagacgctcgtccccgtctcggctattctaggatcacaatagcgtcaaagccggcatttttcgctctggcagcgagggtgtctgcattgtctttggatgaaaatgcgccaatctgcactttgtataatccgtcctttaaaaggacaatcgagtcaaaacctttggcttcggctttacttgcgagcgagtcggcattcgctttgactttaaatgcgccgatttgaaccttatataaccctgagctggaagtctttttaaggttaaaggcttgctccagcccgtttgcatgtcctctcgctaagctttgaataaaactgctcgttttcagcttatttgcatcggcaacggtatcaatgaaaccgttctcggtcaagagggcaggcattgccgactcccttaggacgtggaaattcgctgtttttttgccgcgatcggcaaagtcgacagcttgtatcacttcagagtgaattgtcgattgataagtcgtcgtcggggctcctacatctggataaatatagctttcaaaacctgtgcctcccccggaattaacgtgaatggacaaaaagaaatctgctccccagttatttgcggcatttgtccggtcgtttaagctgacatattggtcgcttgtccggctcagcagcagagaaacgccttcatattcattagttaatatcgtacgtaaggctaaagcgatttgcagggttaacgttttctcctgaaggccattacctgttgcgcctggatcagacccgccatggccaggatcaataaaaattttaaccatttttcatcacctcattacaggatatgaaaaaacacggcttctgcttgtacgattatcattcaactgaaaaatgaggaaataaccctttcaaattcggaaattatttctcgggaaagcgcacaattcaacatgaagcgacaacagatacgatccgacatgaaatctgtgcatacgccatatgtttgtatgtactatgggttcggttaacctgcactgattcctgctggttttaagctttgcgttcatattaaatcaagcatttgaaacgttaattgatgagaaaagctcctttcattaaagataccactttataaatcgaaaaaaagaaaaacacttcaggtatcttacggagggtaatacgcttcatacaaaaaaacagcccgttgcatgaaaaaaggattggcgaatggagaaaataatgagaaagaagctcactataatactctgacaaaatgattaaaaacaaaatatcatggtttgtccaccccatgtccgtgaatacaataagaaataaagtatttctcgggaaagcgcaggattccttattgttcccgaaagaagcaattgtttcgacacatgataggcgtttgtcacaatcggcatccgcttgaatatcatatagagagaacagagaggtgaagatgttggagcgcgctgtgacttataaaaacaacggacagatcaacattattctgaacgggcaaaagcaggtgctgacgaatgctgaggcagaggcggaatatcaggctgcattgcaaaaaaacgaagcaaagcacggcattttgaaggaaatcgaaaaagagatgagcgccttagttgggatggaggaaatgaaacgcaacatcaaggaaatatacgcctggatttttgtgaaccaaaaacgcgcggagcaaggcttgaaggttggaaagcaagcgctgcacatgatgtttaaaggaaatccgggaacgggaaaaacgacggttgcacggctcatcggcaagctgttctttgaaatgaatgtcctgtcaaaaggccacttaatagaagcggagagggctgacctggtcggggagtatatcggacacaccgcccaaaagacgagagatttaatcaaaaagtcattaggtggcattttgtttatagacgaagcctactcgctggcaagaggcggcgaaaaggactttgggaaagaagcgatcgacacacttgtaaagcatatggaagacaaacagcatgagtttattttgatactcgccggatattcacgggaaatggatcattttctctcgttaaatcccggactccaatcaagatttcccatctccattgattttccggattactctgtgacccagctcatggagattgcgaaacgaatgatcgatgaaagggaataccagctcagtcaagaagctgaatggaaattgaaagattacttaatgacagtgaaaagcacgacaagtcccattaaattcagcaatggacgttttgtcagaaatgtgatcgaaaaatcgatcagagcacaagccatgaggcttttaatgggagaccaatacttaaaaagtgacttgatgaccatcaaaagccaagatctttccattaaagaagaagcatctggatctgcatagacctctctgtttttgagaggtctgttttttgctcgtatttccgcttttcaaagcaatcgatttgtggtatacacatgcagggtttggtatgataatactactgcccaatatgcaaaagaaaggaacatccatttgaacgaacaagaaacgattcaggagaaagccattttagtcggatgtcagctgccgcatatcacggatgagcattttgaaaattctatggaagagctagcatctctgacaaaaacagcagacggaaaagtactgaccagcgtcacacaaaaacggaacagggctgacgccgctacatatataggaaaagggaaggtagaagagctgaaggcactggtggaagagcttgaagctgatctcctcatctttaatgatgaactgtcgccaagtcagctgaagtcattggcaacagcaattgaagtgaagatgattgaccgcacgcaattgatattagatatttttgcaaagcgggcgagaacgagagaaggcaaacttcaaattgagctggctcagctgcaatatgcactgccgcgtctgacgggacaagggatcaatctctcccggcaaggcggaggaattggggcaagaggtcccggggaaacgaaactggaaaccgaccgccgccatatcagaaatcgcattcatgaaatcaacacgcagctttccactgtcattcgccatagaagccgataccgtgaaagaagaaagaaaaacggtgtgcttcaaattgcgcttgtcggctatacaaacgcagggaaatcaacatggttcaaccgcctgacgagtgctgacagctatgaagaagatctcctgtttgccacgctggacccgatgaccagaaaaatggtcctgccaagcggctacagtgttcttctttcagatacagtaggatttattcaggatcttccgacgacattgattgctgcattccgctcaacgcttgaggaagtaaaagaagcggatttgatcctgcatttaattgattcttcaaatgaggattatgcgggacatgaaaaaacagtgcttgggcttctcgaggagcttgaagcagatgatatcccgatgctgacggcttacaataaacgtgatcaaaaactgcctgattttataccgtccgccggaagggatcacattatggtcagtgcgaaatttgaggacgacgctgcagcctttaaagaagcgattcagcgctatttgcgccaagaactgctaacgtcttttgaagcacatgtgccggcaagtgaagggaagctcctttccagaatcaaatcggaaacgatggtagaccgcttctattttaatgaagaaaatgaacagtatgacatatccggctatgtccaagaagagcaaagtatcatcggtgaattaaagaagtatatgtaggaaggaaatataaagacatgtttgacacattaacacacggagaattattgaagaaaacggcaatggaagtggaagcggacattgccggcattcataaacaaatagaagaaatcagcgagcgaaatgagtggagagtgcttcaaagctatagaaaacacaaagtaagcgacactcatttcacgccgtctactggatacggctatgatgatatcggaagagacacgcttgaaagcatatatgcggatgtgtttggcggagaagcggggcttgtaaggccgcaaatcatttcaggcacacatgccatctcaattgctttgttcggtgtcctcagaccgggggacgagctcctttatatcacgggcaagccgtatgatacgctagaggaaattgtgggcgtcaggggtggagaaaacgctggatcgttaaaggattttcaaatcggctataatgcggttgatctgacgaaagacggaaagatagactatgatgcagtcgccgctgcgatcaatccgaagacaaaagtaatcggcattcagcgctcaaaaggatatgcgaatcgcccttctttcttaattagtgaaataaaagaaatgatccgttttgtaaaagaaatcaatgaaaatctgatcgtctttgtggacaactgttacggagaatttgtggaagagcttgagccttgccatgtcggagccgacctgatggcgggatctctcattaaaaatcccggcggcggccttgcgaaaacaggcggctacctcgtcggaaaagcgaaatggattgaagcttgctcataccgtatgacgtcacccggcatcggcagagaagcgggggcatctctttactcgctccaagaaatgtaccaaggcttctttttggcgcctcacgttgtgtctcaaagtctaaagggagcggtgtttacagcgagattccttgaaaaactcggcttcacttcaaacccgaaatgggatgcgaaaagaacggatttaatacaatccgttgagttttctgacagagaaaagatgattgctttttgccaggctattcaatttgcatcgccaatcaatgctcatgtgacgccttatccagcctacatgcctggatacgaggatgatgtcattatggcagcagggacgtttattcaaggagcaagcatcgaattatcagctgatggccctatccgcccgccgtatgtagcgtatgttcagggaggattaacctattcgcatgtgaagaatgccatatgcagtgcagtggattcattgatggaaaagcaattaatttaaattttttaaaaatttctctggatttgatgttaagaatccttacatcgtattgacacataatataacatcacctataatgaaactaagttaagaaaaggaggaaattgagatgagtgataatattcgccgctcaatgcctttatttccaataggaattgtcatgcagttaactgagttatcagcaagacaaattcgatattatgaggaaaatggactgatatttccagccagaagtgaaggaaatagacgattattttcatttcatgatgtagataaactgttagaaatcaagcacctgatagaacaaggtgtaaacatggcaggaattaaacagattctggcgaaagccgaagccgagccagaacaaaaacaaaacgagaagacgaaaaaaccaatgaaacatgatctgtccgatgacgaactgagacagctcctgaaaaacgagctcatgcaagccggccgttttcaaagagggaatacattccgtcaaggcgacatgtcccgcttctttcattaatccgttagcaactgttttgctatatacatttaccttttaagaggaggaattttaccaaatggcaaagtacactagagaagatatcgaaaaattagtaaaagaagaaaacgtgaagtatatccgtcttcaatttactgacattcttggaacaatcaagaatgttgagattcctgtaagccagcttggaaaagcgcttgataataaagtcatgtttgacggttcttctattgagggattcgttcgtattgaagagtcagacatgtacctgtatccagatctaaatacatttgttatcttcccatggacagctgaaaaaggtaaagtagcacgtttcatctgtgatatttataatccggatggcacacctttcgaaggtgacccgcgaaacaacttaaaacggattctgaaagaaatggaagacctcggcttcagtgattttaaccttggacctgagcctgaattcttcttattcaaattggacgaaaaaggcgagccaacgcttgaactaaacgacaaaggcggatattttgacttagctccaactgatttaggagaaaactgccgccgcgatatcgtacttgagcttgaagagatgggctttgaaatcgaagcgtctcaccacgaagtagcacctggtcagcatgaaatcgactttaaatatgctggagcagtccgctcttgtgatgacatccaaacatttaaactagttgtcaaaacaattgcccgcaaacacggcctgcatgcgacatttatgccaaaaccattgttcggtgtgaacggttcaggtatgcactgcaatctatcactcttcaaaaatggtgttaacgcattctttgacgaaaacgcagatcttcagttaagtgaaacagcgaaacactttattgcaggtatcgtgaagcacgcaacaagctttacagcagtaacaaacccgacagtaaactcttacaaacgtcttgttcctggctatgaagcaccttgctatgtagcatggagcgcgcaaaacagaagcccgcttatccgtatcccggcttctcgcggcatcagcacacgtgttgaagtacgcagcgttgacccagctgcaaacccataccttgcacttagcgtattgcttgctgcaggattagacggaatcaaaaacaaactggaagcgccggctccaatcgaccgcaacatctatgtgatgagcaaagaagagcgcatggaaaacggaatcgttgaccttcccgcaacacttgcggaagcactagaagaattcaaatcaaacgaagtcatggtcaaagcgctgggcgagcacctattcgaacacttcatcgaagcaaaagaaatcgaatgggatatgttccgcacgcaagtacatccttgggaacgcgaacagtatatgtctcaatattaatctctcaatcccttggcactattggtgtcaagggattttttgatttattaaacaatttaataatttaatatagaccatgtaacaccagacaaaagggcgaagaaaaacggcattgccggcgtgtatggtccgaaaacagcaaacgcggtccaacggttccagtcagtatgtggcctttctgctgacggcatttatggacctaagactaaagcgaaaattgaagcgaaattgaattaataaaagaagcccttcttaaaagagggctctttttctagctatgttgttttaaggtgttttctaatttgttcagtgacttgcttaagccattccaagggtgttataccatcttcaggaaagtatataccatccgctgcttcctctataaattcattcttgtcttcttctgaataatcactatttaaaaactcagttagtactattaaatctctttcttttagtttttgtgatgcttcatttagatattcattaagagcatcttcaggagattctatatcttggtggaaatgtcagccgagaaatctaaatacaggatcagaaactttaatttcaatcattgcttatatagcctcttttatttctataattacttttttcaaccattgtaaaggagttaaatcgattgccggaaaataaatctccgtatatgattttataaaactttctttctcttgatcagatatgttttcatttaaaaactcttcacaaaattttattgtgaaaactaagcattctttacttgattcagctataaattctttcaaagcttgttctggtgaacccatgtcctggtgaaatgttccttctaaaaaatcacttaattcttccagagtatcataattctcgtacattgttattcagaactccttttattttgtaggatagccagttaaaataaattccccatttttactctttttcaatactattgtagcgttggtagcatccttagcaacatttgaacctttttctactcttctgccgagaacttctccatcacctttgtatcttaaaggaagagtacgtctactgttaggattagagagccatttttttattttagtaatgttttttggatcacttagaactgaactggcgactttttctgcagtagctctatctttaaatgaagaagacccagagatttctgtatcttttattaaacgttgaaataattcgccatcagtctccccgacatgtctttctataagatgcccgccttttgcttcatgagcagctaacccgccgccaggtgcgagaggggtactatcaccttgtttgacattacctatacctatgttgttagaagtttcagattttctgagaacactctcttttttatcttccgcaatactttttagcaacggagtatttttcacgttaatggtattctcagcatcttgaaggatcccttctaatgcaggagtataccgatttacaggagatttgacaaactgttttacagatttaccgccttttttaattgtgccaccagttgctttcccaactttagcaagatctttcgagcctgttgagacagaggactttccacctttcaacaacaggagacttccgcccaaataagtaacatagtgcagccgtgtgtatgcatccccgtgaatcatttttgtatcccaattatccttcaatgtgtcaaccatactttgaaaggcagcttgatagtcgtattccaaaacggtatccagcacttttttaggatccttgtttaagttatcaatcgtccaaccgatattccatccaaattgaatggctccttcaccggtatccttggcaagatcgtatataccaacaatcgcccccttggcgccatcacctatgattttcaacacttcttttccgttatccatgaaagctttacgctgttcaagaaatgaaacaaattcaagctgttcaggggtaagattctcatagccgaccttcttggcaatttctaagtattcatccggatccgtcactccgtcagctagcttcttctgtttctcgttctttcgcttcatctttcttgatcttcaaataagcttcagtctgtttctcaatatcgccttttttcttatgtatgtcactttcacggtacgccttggcgttgtagtgaatgggcgtagcgtttttcccttttcctgtggactcctcaagcttttggaagtctttcttgatgaattgttcgtttggctcagactgggtgtattcacgctgcctaatttatcaactgtttttttacgtttgttttccgcatcagcaagttcgtctttgaagttttctgtcgagaacaaatcaagcggaagaatatcgtcgatatcatgtaagatatctttcatggctttcttttgttcagacataattgattttgattttgtgtaggcgttagccagctcgtgttctaagaaggattcttctatatatgcatcagataagctggcgtcttctaaagtgcctgaaatgctcgtcaagaaagcaattttcatatcaagtaagtcaatccaattgtcagccacacctgcatggtcttgataaaatgctttaatgttgtcggcgcctttgccggaaaactcactgtcatctagatcagctacagctttaaaagccttttttagattgaccatctgacttcttaattctttgtattcctttgcacgtctatctgcttctgaaagcagtgatttggcttcaaatactttcatgatcatatcctttcgtttgaatatctccaacaagattttaccatgggaaaatgaagaaatagacaaggatgtgattcaaaagtgagaaatgattaatttgatctgtgtcattttacctatctgaattaattgaagaccgtttacgcagtcaggcggtttcagtccatgcatggatatcgcataacaaaaatagccctttagcaccttactttttttgttaaaatgatgaaaacagcaaggggagataatatggcattactacgctttataagtttatatggaatagccatcattatactgatggtcatagcgaattttgctccttttttggcgatgccattatactatgttgccatggctacattagtctttctgattgtttatctgatatatcattattcccaaaagtttagaggggggaaaaagtaaacaagcaaaaagaattccaaatatttttttgcgcaaatttcgcacaaaaatatggttataaatcctattaaatcaattatttaataggggtgataaactccctcctaggtagtaagcatattattcataaaacatgcttttgaccaaaattaagaccaaaatttgaccaaaaaaattaactaatcatacttaatgtaatacaaatctcaacgaatgaatttgctgaaacgcttgataagtaagggttttgattgttatagattagctattttatctaaagaatcatgttccgcacgcaagtacatccttgggaacgcgaacagtatatgtctcagtattaatctttcaatcccttgtcactaaaggtgtcaggggattttttatgttaataggtaataaattatggagcggcactgctaaaaagcagggtcacttttagtctatgtcactaataattctatgtactaaattttcaattagggaaataattccacgcttaaggaagcaatacgcataaataattcgacaaattctgtgataattccattgttcaatacttctaccagcaataataagatgagtaaggtagatgtttatcattgacatcataaccaaatgaatccataattacgttgaaatctaaatcaattttcaaaaaggagatttctatgaaaaaattgactatcttctccgggggattaggagcggttttttctgtactggctcaactgtttgcggttatagatgactcttacactttggggaatttatggtttttaggtgctttggcgggaattataaccatgcttgcttcaatccagacaaataataaaccagtcttcagcatattattaattgctagttcagtaataggtctacttggaactggtcttgtatacatcataccaacacttttcaatataataataatttataaattttcaaaagtaagccaatggtaaaataaaggttctttttttatttagtatccctttgacaaggtcggtaatgaatcgcagaatgttgcagctagggcttccgtgggcatgattatcgaacgccatgtttctaggataccggaattgaaacatttgctgagacatttcgtgaagctgatcaccaaatgaccattttcatagaggcacgtctaaagaagctatcataggaggacaatactgtgtggaaagctttaagtcaattactcaagaaacagaaaaatcaaagtccaagcgatgaagattatatacagattccagaattagaagtaaaagttttggggatgcttcacagtatcaatatagacttggttaatttaatagctcaagcagaaaagtctaaggagtttataggacaaatcgaaggcatctggcattctatagcaaatcaattttattcactcgcccaagggtttgagaatgaggatatcaataagctttctgcggatcttgatcatgctgccgccacttgggaaactgttgctaataaagcaaaagagtttgtaacaaattcataccatgggtaaaagaaaaataagggcctgaaagggctcttttgcttatagtcatatttcccgtaagtattactttttggatgtattaaattttaaagcgtgtttgtttcactgaattcatagtcaaaaggggaatgtttttatgcttggaatcaacgttgaaaaatcaaatgaaaacttaattatcaattggcagctatccaaaattgaaattccaatcaaagaaatcaatgatgtatttcttgatccaaactatggggagaggagaaaagcgcagtaaggattaggtttccttatggctcaacagatagggtagtaattaaaacagcatataacacttacattttgttcaccactaatcctgctttaattatgagtaaaattgtttcttaataaacagtttatgtcccttttaaatttatcttaatgttctgtgtggtaaaatttagtgagatgatttaaggaggaggagcatttatggaagaaggaaagttagttcacatgacattagatggtattaagaaagcagttactaaatatggtacatttcctgtgttccatcatggggttatgtcttggaagatgctacttttcatttcaaaaatccagcaactcctcaagaaattagcggcttagaaaagaaattaggtgttacttttcctaatgactttaaagagtttttgttacaacacaatgggatggaaatgtttgatggcattgaaatacttagcttagagggaatcgttgaatataatgaggttcaagatttcccagagggatacttattaataggatatcattttgatggaaggtatgtcatagacacaaacaaatcaaaaaaaggattaggttatatgttatatctagactcaattgacgatattgaagatgcgattaacttaaattctaatttcgagatatggtttgatatgctagtgtcttctaatagaacgaaatattgggaagtaaatccgaatctccaagagtattataaactggtttcagaataacacttcggcaaaagaaaaaattatgactaatttcaacaaccaaagattctgctatttgagggaagtataatgacaatttacgagcaaattaaagatgctttaaaaaataagatcaatgagttgctttcacctcaagaagtaaagaaaacccttcaagaaaaatacggaactaacggatagcattattttatcagattattgttataaccggtataataaggggatttcttttaataagcacctctttgaatatgtgaatagaagttcttacaaatacttaggtgaaaactctctttatacaggacttattttcagaaaatcaaaaggggaagataaggaagttatcgtaggcgaatgggtaaacggtgttaaatcactccgagaagtacctattactaataaccaaatacatgatcaagccgaaatcattagtaaagaacaacttgtaaacctttataatgaatataaccaaatcttgagatatgaaatgaatgtattgaactgtaagcccacagaattgaggcatttaattggcagaatcggtgaattcatttgtgcaatccaaaccaacggcactctggcacgtcaaactaatcagcatggatttgatgttgtgagtgatggcaggcggattagtgtaaaaacaacagctcaatcaagtggttttattttgataaataaaaatacatttgatgattttgatgttttttttgtagttcaatacgtaaatgatgattttaaagttattttcttcggctcaaaggaagaagtgcaaaaaataagcagagtttatggaagccaatacgaagttgaaatttcacttcttaaaaagcttaataaggaataccaattaaattaaacaatcttgttgataacaaacattctcttacttattgtaaggggatgtttgtttaatccttattttatcttcgcaatctggcttacgagttgcatccacagtaaatgatcttacttcgtcttttccccgtgttacttttttctattgagataaccattgattttaatgccgctcattgggtttacctcataatcatcagtgtaatcgtaatcaattgattcaatatctttatcgtttgttttaataaagccaagccagtcattagccaatgaatacaactcttctttttgcagagctacttggacttccattttttgttgtgttgttccttcataattgtccctcagagaagggtaagggaattatttttgagaatcatattccattgcttgttcacagtcagaaatccttgagttgttctagcaagaggcaatattgttgaataaggatagttttaaagaggttattgttgtcttcatattgaaataaagattaagtatattagaggggagttgctttaatgcacataacaacaaaaaggttattgatacgtgaatttgaattcaaagattggcaggctgtatatgagtatacatctgatattaatgtgatgaagtatatacctgaaggggtttttactgaagaagatgcaaaggcatttgtaaataaaaacaaaggtgataacgctgaaaaattccctgtcatactaagagatgaagactgtcttataggccatattgttttttataagtattttggtgaacatacatatgaaattgggtgggtgtttaatccgaattatcaaaataaagggtatgcttctgaggcagcccaagctatcttggaatatggatttaaagaaatgaacttacataggattatagctacgtgtcaacctgagaatattccttcataccgagttatggagaagattggaatgaaaagagaaggattttttaaaaaatgtattccaaaaggcaatgaatggtgggatgaatattattacgctattttagaggaagagtggaattgtaagagggataatgcaggaaattgaaaccataacagctatagaacgtatagtgatagtagggcttatagtgcttaatatgaatgatgtgagaggggtatccaaatgcaaattcatctcaccaaaagcggaaaacaagacaatcatcataaatggttaggaactgtcttgctcagttggggaacattcgtatttgctttgttttttgctactttagttggttcaatggctagccaagcaggagcttccaagcttttgaagcatggcatccaagctggtttagtcacattaataactgtcccgttgctctacattcttcttaaacggatgtctagtagacccttttattctataggactgtctgggtggcggcaagctattccgaaagccattatgggagcaatatatgtgattgtattatccgggtctggtttcgctatcgcccatttattaggctggatcaaagttacacaatttcacttctctgtccatttagtgacagcattgctcttaaatatgattatcgctttcttttatgaagcttttccagaggaattaacttttcgggggacggtgtactatgctctaaataagcgttggaactgttttatggccttactcctacagccgatcctgtttgtgcttgcaccaataactgtaagtggcttgcaatatatagctggaattgaatcacctgctatcacattagattacatcgttttattgttgacttttggatgcatccttcaactcctccgtattgtaacaggaagcttatggacgtctatcgcttttcatctagcctttcttgaaaattctcggttcttcgtcctgcagggggaggagcgctttattacctatgaagaaattgttccgggaacaggttcgctgtttgtgatcttttttatgttgcttattgtcggtactctactattaatacctgttgcaataactcgccgaaatactattcaatggcggaagaatgagaaatgcgaccaagatgtttaatttctgagtagaacagtagttttaaagtgattttaaggaggatctagacaatgttgaagaagcattcctgatgaaagattagtagattttgattctcaaggtggaaaccttattagtttttttttagttactcactgtgagttatctgatcaatcgtataaaaatgtattaagctttaatgatgatcttttgggtatgaagcataactgttcgtatgcaatggatattctaagcgttaaagaggaatttgatttcgatttcccatttaatatgcttgcaataaaaagctacgtacaagaattaataaaaatgttagggattgatataactctgcctgaaatgaaagaaagagattttgacaaactttctcaagattaaataaaactacgattttaaagagaacggagacttgctttcaatatgaatgttaaaaaaactgcagctattttttcaatcacgattccaattatctcagctatcctaattattaatttttttacgggagttatgtcaattccatggcaaggaatgccggtgttttttccattattgctttctcctataggaatcattttagcgttcgtttcaatgaagacaaataaacggtgtgctgtatatgggattgtcttaaatgcaattatgtttccatttccttttttctggtttatcggaggggctttgttatttggagtttaatccattaggcattacgcttatacattggtattttcgagcttgtcaaaagaaggaataaaaaattttcagaattgcttggctttactttattttgaaaggggtcgagtaagatggataggaaaaaggatgaaatacaaagaaaatataaggaacaaatgagggagaagaaagaacgagaaaaagaagatggcagttcacatacttttgaaattgttgttgtgctagccattatcattttgatgtttttctttaattcagttttcaaggctttttagatattgtacagatgactttcaggatgtttgaaaaataaccctttgagatatataccacatgaaagtattgaaggacttatgaaaattcaagagccagttgaatcttaataattaatcaccaaataatggggatgtaaaatgaaattgtataatgaatttatcaatatagctaaaacgtttaataaagagttagacataattccattattatatggatctttaggtcttgaaaaggtaactgggttagacttttccccagaagatattgatatccttattcctttaatttttttagaggaaaagtgggaaaaactaaaaaaagtgatggaactgcatggatacaaaatggttgatttacatgagcatgaatttaagaaaactaatacaaaaataggcattgcttacattgaggatttaaaaccatttgcagatgtagactataataacctagaggtttttgaagatggcggagcgaaatatcatttgctaacgattgatgattacctcaaggtttataaaaagtctttattagatggttatagaagaaggaagaagaatcataaagaccaaagtaaaattaacatattgaataaattaatacggaattaatttctgtattctcttttgtttccagtctcaattaaaatttttaagattaaaataagtttgaaaggataaatcatagtgtttaacacagccattaatcctcagacagtcaaaaagccatttctactccggttgaaagcttctcaatttttgcttcttatttatctttcctgtattgatatatgtatgtagggttggacttataacataaactattctgccattcctgttctttcaattcatgaccgggcttgccatcagcataaatctaggataacagtctccatacatcctgtgatcacctttatcaaactcttaaatgcaacttaccactaaccaattccttatttcgcatagatcatctttgtcatgtgtttacacaagaatctgttttggactaatcgtcgttaactgatacatgacattcgcaaatatttgagacactgaatataacgaaacagtcaaaaatcaatatttaattcattctgtttaaactttctgaaaaagatgttgaaaaagtcgagaggattttataatattaaatcaagttagtttgttcgatcgacaaactaacaagatgaactttcattgtccacaagataaggtcttactgaatatggatggaaggggataagagggtcgatttaatggagctaaacaatataagaaacgaaagaatgaggcttttatccttttccaggtatataaggtatgacgaaaaaagatgaattttctgcttgctgatcaccatatttttttgcactgttttgaaagcgcttttataaaagtttactgaccgtaaattcgagaaattgttataccgtttcacactgttccatattaaaggatcgaaaaggggagaaatcatgctcagtgaaaatgtaaagaagattagcatggttgaaaaagttggatatgcgtctggagattttgcttgtaatttaatttatgcaacagtgtctacttatcttttgttcttctatacagatatttttggtttatcggcagcagcagccggtactatgtttttagtggttagaataatcgacgctctcgctgatccttttatcggaacaatagttgacagaacgaacagcagatttggacgctttagaccgtatcttttattcggagcttttccatttgtcatactggcaatactctgttttacaacaccagacttttcggatatggggaaattaatatatgcctatataacctatgttggcttgtcgcttacatacacaacgataaacgttccatatggcgcgttaacttctgcaatgactagaaataatcaagaagtggttagtataacttctgttcgcatgttatttgcgaatcttggggacttgtcgttgcattttttgttcccttactggctgcttatttaagcgatacttccggcaacgagtctcttggctggcaactaaccatgggtattttgggaatgataggcgggtgccttttaatcttttgttttaaaagcacaaaagagcgggtcactcttcaaaaatccgaagagaaaattaaatttacggatatatttgagcagtttcgtgttaatcgtccacttgttgtattaagtattttctttattattatttttggagtgaattccatcagtaattcggttggcatttactacgtaacgtataacttagaaagagaggatttggtgaagtggtacggtttgataggaagcttgcccgctttggtcattttaccgtttattccaaggcttcatcaatttttggggaaaaagaaattactaaactatgcattattactgaatattatcggcctcttagctttactgtttgttccgccaagtaatgtttacctcatacttgtctgtcgattaatcgctgctgctggaagtctcactgccgggggatatatgtgggcgcttattcctgaaacaatagaatatggagagtacaggactgggaaaagaatgggtgggctcatttacgctatcatcggatttttctttaagtttggtatggccttaggaggagttgttccgggtctggttcttgataagtttggatatgtggcaaatcaggcacaaaccccggcggcattaatggggattttaattacaacaaccattattcccgtgttcttgctggttctagctttaattgatattaatttctataacttagatgagaaaaaatataaaaacatggttcgagaattagagaatagagacaaagtttatttggaccatattgatgatttcaaggcttaaaaaagaaaataaactgaggaggagtcccaaatgaagattaccaatccagtactcaaaggattcaatcccgatccaagtatttgtagggcaggagaggattattatatcgctgtatctacatttgagtggtttccgggagtccagatacaccactcaaaagatttagtaaattggcacttagttgcacatccattacagagagtttcacaattagacatgaaaggaaatccaaattcaggtggggtttgggcaccatgtttaagctatagtgatgggaagttttggctgatctatacggatgttaaggtagtagatggcgcatggaaagattgtcacaattatttagttacttgtgaaacgattaatggtgattggggggagccgattacattaaatagctcggggtttgatgcttctttgttccatgatacggatggaaaaaaatatttattaaatatgttatgggatcaccgtattgatcggcactcatttggaggaattgttatacaggaatattctgataaagagcaaaaattaatcggtaaaccaaaagttatatttgaaggaactgatagaaaactgacagaagctccgcacctttatcatatcgggaactattattatttattaactgcagaaggaggaacacggtacgaacatgctgctacaattgcccgttctgcaaatattgagggaccatatgaagttcatcccgataatccaatcttaacgtcatggcatgacccaggaaatccattgcaaaaatgtggtcatgcatccattgttcaaacacatacagatgagtggtatttagctcatttaacgggacgtcctattcatcctgacgatgattcaatttttcagcagagaggatactgtcctttgggcagagaaacagctattcaaaaactttactggaaagatgaatggccctatgtagtaggtggaaaagaaggaagcttggaggtagatgcaccttctatacccgaaacaatatttaaagcaacgtacccggaagttgatgaatttgaggattcaacattaaatataaattttcaaactttaaggattccattcacgaatgaattaggttcattgactcaagcgccaaatcatttacgattattcggtcatgaatcattaacttcgacatttactcaggcatttgtagccagacgctggcaaagtctccattttgaagcggaaactgctgttgagttttatccggaaaattttcaacaagccgctggattggtgaattattacaatacagagaactggacggctcttcaagtcacgcatgatgaagaactgggccgcattcttgaattaacaatatgtgacaacttttctttttcacagccattaaataataaaattgttattcctcgtgaagtaaagtatgtatatttaaaagtaaatattgaaaaggacaaatattattatttctattcttttaacaaagaagtttggcacaaaattgacattgcactggaatcgaaaaaattatcagatgattacatccgtgggggaggattcttcacaggggcctttgtagggatgcaatgccaagataccagcggtaatcatataccggccgactttagatattttcgttataaagaaaaataatttgcacatgaaaaaggagatttctattttagaactcctttttcatatgagaaggtgcctatatcaatattgcttcagaaatactcctagaataaaaaagctcatctttaaagatgagctgtacattccattaaaattacattgtaaccatgtccagaaaatgatcaatcacaatggaggacattcctaatgccggcgcattctgtcctaaggaagatggcaataattcatagctattgcctaaatgggaataaacccttgacgatacttcacttctcattgaatttaaaaccataggatgcgattcaattatgctatttcttaaaattacggcttgtgggttgaaagtatttagaatattggtaaggcctattcctaaatagaatccaaaattttgtaatgcatttaaggttccgatatcattcagatgggcgaggtttatgatatcttgataggacagttttttctctttagtctgaagagattttaataaagccttctctgaagcatacaattcccagcagcctcggtttccgcaactgcatttaggaccattaaagtctattgtcatatgtcccatttctccagagaagccgcttactcctctatataaatgattgttgataataacaccgatccctatccctgtgctgatacttacgtaaataatgttatcgtgattttttgcagctccaaatactttctctccatatgcgccagcatttgcctcattttcaataaaaacaggcacattgtacttctcttgtatcgaagattttaagtcaatatctctccagttggagttcggagtgaaaacaattttttgatctttatcaacgagtccaggcacgcaaatacctataccaataagcccgtacggagattggggcatatgcgtcataaagtgatgaatcatatcaatcaaaatgtctttcgttatttctggagaattggattccaaatggcagtattgatcaagaacgatcgttccttcgaggtctgttaaaatgccattgatataatccacaccaacatctattcctacggagtatcctgcctttttattaaaaacaagcatgacaggtcttcttccgccacttgattgtccttgacctatttcaaataccagattttctttcattaacgtgtttacctgtgatgaaacagttgatttatttaatccagtcatttcagataattttgctcttgaaataggtgaatttttaaggatttcttttaataataacttttgatttacttttttgacaaaggtttgatcagcgatatccacttcatccactccatttgtttaatctttaaattaagtatgaacatagtacatagcgaatcttccctttattatatctaatgtgttcataaaaaactaaaaaaatattgaaaatactgatgaggttatataagatgaaaataagttagtttgtttaaacaacaaactaataggtaacttacaatatgaaataaaatgcatttgtatttgaatgatcatgttttgaatttatttttgagggggaaatcacatggctcaatctcattccagttcaattaactattttggaagcgtaaacaaagtggtttacgaagggaaagattcgactaatcctttagcatttaaatattataatcctcaagaagtaatcggcggaaaaacgatgaaagagcatttgcgattttctattgcctattggcatacatttactgctgatggtacagacgtttttggagcagctacgatgcaaagaccatgggatcactataaaggcatggatctagcgaagatgagagtagaagcagcatttgagatgtttgaaaaactagatgcaccattctttgcttttcatgacagggatattgcaccagaaggcagtacgctaaaagagacaaaccaaaatttagatatgatcgtgggcatgattaaagattacatgagaaatagcggcgttaaactattatggaataccgcaaacatgtttacgaatccccgtttcgtccatggtgccgcgacttcttgcaatgcagatgtgtttgcgtatgctgcagcacaagtgaaaaaagggttagaaacagcaaaagagcttggcgctgagaactatgtattttggggcggccgtgaaggatatgaaacattgttaaataccgatttaaaatttgagcttgataatttggctagatttatgcatatggcagtggattatgcgaaggaaatcgggtacacagggcagtttttgattgagccaaaaccaaaagagccgaccacccatcaatacgatacagatgcagcaacaaccattgcctttttgaagcaatatggcttagacaatcattttaaattaaatcttgaagccaatcatgccacattagctgggcatacattcgaacatgaattgcgcatggcaagagtatatggtctgcttggctctgttgacgcaaaccagggtcatcctcttttaggctgggatacggatgaatttccgacggatttatattctacgacattagcaatgtacgaaatcctgcaaaatggcggcctaggaagcggcggattaaactttgacgcgaaggtcagaagatcttcttttgagcctgatgatctaatatatgcccatattgcagggatggatgcatttgcaagaggattgaaagttgcccacaaattaatcgaagatcgtgtgtttgaagatgtgattcaacatcgttaccgcagctttactgaagggattggtcttgaaattatagaaggaagagctaatttccaaacacttgagcaatatgcgctaaatcataaattaattaaaaacgaatctggaagacaggagcaattaaaagcgatattgaaccaatacattttagaagtataacaggataagctccagatcctgctatcaataccaagtcactgaattacccgtcatgattcctttcctattgcttgttgttatgacgggtaacttctataattaggatttatttagagtgaatggttttttaaaagggcaaggagtgaaaaaatgaagtatgtcattggaatagatcttggaacgagtgctgttaaaaccattttagttaatcaaaacggcaaggtttgtgcagaaacgtccaaaaggtacccgctcatccaagaaaaggcgggatatagtgagcaaaatcctgaagactgggtgcagcaaacaattgaagcattggctgaattggtttctatatccaatgttcaagccaaggatattgacgggataagctattcgggacaaatgcatggattagtactgcttgataaagattgtcaggtgttacgtaatgcaattctttggaatgataccagaacaacgcctcaatgtataaggatgaccgagaaatttggcgatcatcttcttgacatcacaaaaaaccgtgttttagaagggtttacattacctaaaatgttatgggtgaaggaacatgaacctgaactttttaaaaaaactgctgtttttatgcttccgaaagactatgtgagattccgtatgagcggtgccattcacaccgaatactccgatgcagcaggaactttacttttacatattactcgcaaggagtggagcaatgatatttgcaatgaaattggtatttctgcagatatttgtcctccgcttgttgaatctcatgattgtgtaggatcactgcttccgcacgttgccgagaagaccggactattagaaaaaacaaaagtgtacgctgggggagcagataatgcttgcggcgctattggagcaggtatcctttcttccggaaaaactttatgcagtgttgggacctcaggggtcatactttcctacgaagaagaaaaagaaagagactttaaagggaaagtccacttttttaatcatggaaaaaaggattctttttatacgatgggcgtcacgctcgctgcaggttacagcttggactggtttaaaagaacgtttgcaccaaacgaatcgtttgagcaattattgcagggggtggaagctattccgataggagccaatggactgctatacactccttatttagttggtgaaagaacgccgcatgctgattcttctattcggggaagcttgatcggaatggatggagctcacaatagaaagcactttttgagggcaataatggaaggtatcacattctctttacatgaatcaattgagctattccgcgaagcgggaaaatcagttcatactgttgtttctattggtggaggagctaaaaatgataagtggctgcaaatgcaagctgatattttcaatgcgagggtgattaagttagaaaatgaacaagggccagctatgggagctgcaatgctggctgcatttggaagcggttggtttgaatcccttgaagaatgtgcagagcagttcattcgtgaggctgctgcattttatccaaaggcacaaaatgttcaaaaatataaaacactatttgatttgtataagaacatttacactcacacaaaggatctcaatacagctttgaagagctttcgaaaaaactaatgatgttattgtctggagatcaaccgacgaacaattaatgatcaatcatcatcaaaggcctttgatgacatggctgccttcttttgaaaagatggtgagaataaggtatcgcaacctttaaacagtattggagtgtccagcagacaaaacgaacgagcggaactgtattctgtcagcgaacacttcaagaagtgagaaagcttaggaatgccaatgggtaagatgtatgaaaccgcgctaacgacggtagagggatctcttgatttatgatgaaataggaaggatgtttacacacaaataaccccctcacattgacgtgaaggggtgttttttattgttactatacagcggaaattttacaggctagttgcatgattttagcttgataagcagaatggaaactagacacgccatcatctctttctcattctttggaaactgcattctgctaggtttgctgctttttttaacaaacagtgtttttctatttcacacagccattaaatcctctgtttgtcacataaccgctcttactccaaattgacagtttatctgattttgcttcttgctcatctagtctgaattggtctatgtattttgtgttaggctcatatacatatgctactctggccaatccctctttcaataatgtctcttgaacagatttgccgtcaacataaacatatgctaacagtcttccatacttatctctgcgatcgcctttatcaaattccagctgtagcttaccgctgttgaccaattctttatttcgtttcgacgcatcctcaccgtatggttgaacacaagaatttggtttcttcgtctcaggtgtatcaacgagcaagtagcgaactgtgtctttctttccgttgtaaataaccttaatcgtatctccatctattgctctatctaatgtaacattgaccaatttcttctgcttttttgaatgaggcgtgccggccttttgttctgtctgattatattcattagattgagtatcttgagagacttgctccgtcccattagaatctgaatggtttttggctgcgtgatgtgatccgcaagctgccaaagtaatacttaaaacgattgcgatcatactgatcaaaatcttcttcatattgattccctctttatcattttctcttttcgcgattaaacatcatcattataacgatatggacattttttgtgaatggaaaacttcaagggaacttataacactcaaattgccaatagttaacttcacaacgagatgatcaaaacatcaccatcacatagcggaaataaataatcctgaaaataatattgattgaaaatgcttttggaattatgataatatgagaaatgacaataatgtgacaaaaatattactacaacataacaactaatagcttaggtttattctactgtctaaaaatgtaaacggttacaaatccagaggcgaaaatctaagatagagatgactttagttttgactcaatatccacactgaaagagcttattaagtattcttaataaaggcaggggaaatggatatgaatgaacatcgaaatcgaaggttgaaattaataatgatttcagcaacttttggagggcttctctttggatatgacaccggagttataaatggagctttaccttttatggcaaggccagatcagcttgatttaacaccggttacagaagggcttgttacgagtattcttttattaggtgccgcatttggagcgttgttatgcggaagattggctgatcgatatggccgacgtaaaatgatccttaatctttcctttttatttttcctggcatcactgggaacagcgttagcacctaatgttttcatcatggcggcctttcgttttttactggggctggctgttggaggagcctcggcgatggtgccggcctttttagcagaaatggcaccgcatgaaaagagagggcgtatggtaacccaaaatgaactaatgattgttggcgggcaatttttagcatatgtttttaatgcgatcctcggtgtaacaatggcaaatacgggacatgtttggagatacatgctagtcatttgtgctgttccggctatcatgttatttgccagtatgcttaaggtcccagaaagcccgcgatggctaatctccaaaggcaaaaacagtgaggcgctgcgagttcttaaacaaattcgagaagataaacgtgcagaagctgaatgtagagaaattcaagaagcggtagaaaaagatacaacactagaaaaggcatcactcaaggacttttctacaccatggctgcgccgtcttttatggattggaatcggtgttgccatagtgaatcaaattacaggtgtgaactcgattatgtattatggcacacaaatccttaaagaatctggttttggtacaaaagcggctttaattgctaatattggaaatgggctgatatcagttattgcagttatatttgggatttggctggtaggaaaagtaagacggcgtccaatattattgattggtttggcggggacgactacagcgctcctattgattgcgattttctcaattgtgcttgatggatctatggcacttccttatgtagtgctttctttgaccgttttatttcttgcctttatgcaagggtgtgtaggacctgtgacttggcttgtcatagcggaaatcttccctcaaaggttaagagggcttggttctgggataagtgtttttttcctttggatattaaactttgtgatcggttttgctttcccgatcttgcttagctctgtaggtttgtcttttacattctttatatttgtggctttaggtgtattggcaatcggttttgtatacaaattcatgccggaaacaaaggggcgtacacttgaagagttagaagagcattttcgttctcgacacgatcataatactcctgaacaatcagttattgaggtataaatatgttgaaaatctctcttcttataggagggatttttttagtttcagaaaaaacaaaatccccctggtagagggatcttgattcagcattttaagatgttctacacgtataatactggagttgatactttaaaaatctcgccatctcttatataaaaacgagggatgcggcggcttaatgtagacacgacttcatagttaatcgtattgagcatttcagccacttcatcaacggaaatctcggctcctttttgcttaccgtaaatcacgacttcttctccttgtttaccttcaccgttttctcctaaactgaccatgatcatatccattgttactcttcccgccactggcactcgttttccgcgatgaagaacaaacccgcgattggaaagagcacgagaatagccgtcagcatagccaatcgggagtgtagcaattacttcattaggttctgcgatgtatgtagcaccatagctaacggttcggggttctgtccgcatggttttcacataagcgatgcgtgcctttaaacttaacgcaggttcaagcttaacgagatttagttgtttaatataggctgaaggatataaaccatacaagccgatacctaaacggatcatatcagcgctaaattccggaaatgcgatagctgcagcagtgttgcacatatgcacggtgggcagctcaatcccctgtttttttaaaaagctgagaaaactgatgaatttttcgtgctgcagctttgtgagtgttgtgtccggttcatcagctgtcgaaaaatgtgtgaaaatccctgtccatctgaggaatttacttgcctttaaggctttcactacttctaaaagttcttcctttgtgcgtacacctaatcgtcccatgccggtatccgcgttaatatgaatggccagccggttagcactcgcttctttttccaatatctcgtttgcttctttcatccaatcaacctggaatgctgataatgttatattccaagctgctgacttctttacacaactaagggatgtaaaaccaagcacaaggataggtgctgtaatcccagcttttcgtaaaacgattccttcctccacactggcaacagcgagctcactcgccccgtgttccagtgcatggcgtgccacttcgatagacccgtgaccataaccgttcgcttttacgacagccataattttgctcttatgtggaatatgacggcggatcgctcgcaaattctttttaacggcatcaagattgacttcgatccaaacttctcggcaaagctttatcatcaacgcttccttccttcttatggattataaataccacctattgccgcaagtaaatgttaattgttggatgattcgatcttattttattcaactttatttgaaatcattcaacagcaaatccatgtgatacgagaaggtgcctatcaatgttcgaataatagcaagtacgggatacatgaggcttgtaagtggggtgttaatgggtacggcgaccgaggattacaaaaatgattatttgtttcgggacatttttttctaagggtagatgataacgagaaatctaatcaggaaaaacttaccgttcatcaatacaaaggatacaggttagaattagtgatgtttgcagtatagaagcacagaaaaaagcaaggaagtaacagcaagcttccttgctccattgtattcctattagagagcacgcacttttgcaaaagcttttatcttagctccatcatcattttgacagcgaatataatatgttccggttttatagtgtgatacgtcaagagttagagttacacttttgccaggtttaactgtatagccggaagcgattgttccaccacctggttttacaattttgaattcaaatggattgcttcctgtattctcaacaaaaactctgatttcgccatcttcacttccataataatcaaaataaaattttccgtcacctctaaacgtttcttcctcttccagtataatatcggattgtgcggctgcaaacgcagaggcttttttaggtgtgtggtcaattgatgcagctgaagcataagtagagcttaatcctgtaattgaactaactaaaatcgaacctaccacaattttcttaaacacttttcttcatctcctatataagaaataaattacaaatttatacattcggtaaagagttggaaagacctttgggaaatcctataattcacaagaaatacaaaaagggtatgtttatttctggtgaatatttatgacggagtaaacatgtcataatatgaggatgattaaagcgtaatcaagtacggtctgagacaagcaggacactacatatgaaggcactgactggctaacttttctcgacaaagacaagagaacaagagggcgtctattgttatgaacattggaagaaccttttaaatgagaagggctgaggaaattctgtaaaagataatcggttgaaaaggcagtcgattccttgttccataaacctaacatcagagtatataattaaactcgtattcacaaaaatcgtttaagtaaggggtatacatgaataggggagttagttttcaaataccgaatgaatatggaaattttctatggagaatactgcagccggtagaaatagctaattataggtggcaaacgagtggggaatcttattttgttgtagaaggagagctcgataatgaggagctttttcatgactatgcaattgttgaaggggcagtttttgagcaacaattaaaaacgaatcagtactataccattttcgttgaactgaaagcatttccatatggaaaaatggttaatcaagtcaatatatatgaagagtttgctgacagtgattgcgaacttgtccttttgatagcagataatagctacgtttcgatttactgtaaaaacaaaaaaatcattgaaaaactgtacttcaatgctttacagaatgattttgaagacgttcaatttataactgatgaaaatgacacaagaacaagccttactgtatgatagtcaataaaaattaaaggagctagtacatgacaatgcaaattaaaatcaagtatctagatgaaacacaaacaagaatcagcaaaattgagcagggagactggattgatcttcgggcagctgaagatgtaacaatcaaaaaagatgaatttaagcttgtcccattaggtgttgcaatggagctgcctgaaggttacgaagcacatgtcgtccctcgttcaagtacatacaagaactttggcgttattcaaacaaattcaatgggtgttatcgatgagtcatataagggagacaacgatttctggttctttcctgcttatgcattgcgtgatactgaaattaagaagggtgatcgtatctgccagtttagaatcatgaagaaaatgccggcggttgaattggttgaagtcgagcatttgggaaacgaggatagaggaggactcggttcaacaggtacgaagtaaacaaaataaatccttggctgtcttcatgctgtgtgattgatcaatggaggtttcagccaaggtacatataaatattatgtataaaatgaatattttaatacgaaggatttaattaaaaacaaattttaaaaagggaagttttgaaaaagtgaaatagtaataactaaagtcgataaagaacctaaagatgtcaaagaaacaatttttctggtgctttgcttttttgaaggtttacttagctcgtggataactgcccccataaaagcatggatgctaaaattataatacttatatacatatagatgctccttttattatatttacagtttttacatttttattgattttaccactttaggattgagttgtcgatgaaacaagcatctctataaagaaatacttttatctaaatttttataaataggggaaggcaactaaaaactagtaatgccactaataataagccaagttaaatgacttgtgttcattaataattgaattttacagcagccatgagcacaaaaaaatctgagttcgtcgataaatatcataaaaaagcccccggtatgtcgccagggaataaatagacgtttaagagatttagtgatgttttttatatgattcgacaaaatcataataatgatcatcgtcatcataatactttttttcgtaatgataatcgtgatcatcgtaatattttttatcatggtcatcatactttttgtcgtaatcataatgttttttatcatgatcataatacttgtcgcaatcataatgcttcttatcattgtcgtaatactttttgtaatatgtttttttccaagtgtaatactcttctttatattttttataataacccaattaaattcctcctttatgttattcgaatttaatttatgaagtttaaatgatatggtatggtcaaatgaaataagaatagtaaaaagaggctgtttaaaacactttctgaaaaacaaaacggatagctgtttatgaaaataagagcgagagagagcactcaatcactgtaaaataatagtaaagtgtatagagaagattaatatacgtaaaaagggactttctcattgaagaatatttgaacgttatggtcaagattcaagagctctatgatatgatttttaatactgcttttgaaggatttagagttagacatcaaaaacaaacagcaaaaccggttagaaacagatcatataaggaatgaaccgctgccaaatatcataaaaaagttgttaatgatcaaatgaatgaaattagagagaatttattttaaagaaagcccaattgcacatggacaaatgacaattgatattcaggtaaaatacaatgcattaaatcagaaaaagctattggaggatttaatgtgtttagacaatttccaatttggtatacacaaacacctaactatttgaatttttatgtgccgcaatatcaaaccatttcttataatcctcaacaatgttatcaacggtgtatgtaccaaactggcggtaactatgagctatgtgacagactatgttatggagaaatacaggtgtaaaagagggggattaactcctctttaaacacacagtgagtggaataagatcctcactttatctgcaagtgcttagtatttgcgataatattgcattcgtaataaattatgcttagcaactgaaaatgaaagaaggatatgaatagtcatgacgcaattcgataaacaatacaattcaattataaaggatattatcaataatggaatctcagacgaagagtttgatgtaagaaccaagtgggactcagatggaacaccggcacatactctaagtgtaatcagtaagcaaatgagattcgacaactcagaggttccgattttaacgacaaaaaaggttgcctggaaaacagccattaaagagttgctctggatttggcagctgaaatctaatgatgttaatgatttaaacaagatgagcgtacatatttgggatcaatggaaacaagaagacggcaccatcggacatgcatatggatttcagttggggaagaaaaacagaagtctaaatggagaaaaagtggatcaggtagactatcttcttcatcaattgaagaacaatccatcttcacgcagacatattacaatgctgtggaatcctgatgaattagacgcaatggccttaacgccatgtgtatacgagacacaatggtacgttaaacatgggaaactccaccttgaggtaagagcacggagcaatgatatggcattgggaaatccattcaatgtattccagtataatgtgttgcagcgcatgattgctcaagtgactggttatgagcttggtgaatatatctttaacattggggattgccatgtgtacacacgtcatatagacaatttgaaaattcaaatggaaagagaacagtttgaagcacctgaactatggatcaatcctgaagtgaaagatttttatgactttaccattgatgatttcaagttaatcaactataaacatggggacaagcttttatttgaggtagcggtttaatgctgcctttttattgtgcagtgaatagatagcaggtatcctaatttcattaagcaatctggaagatgaataaaaattgaaggacaaacacgtataatacataaaaaagattaactctacagttaatcttttttattcagaagaaaatatcctaactttgaaactaaatacaaagtaaaagcaatcattacagttctagatattacaattccatgaatagctagatcatatccagcaggtatcaacgcatttgtattacacataaaatatatagatattagaagtgctacaataactaaaatcattccaaaaagacttgttttttcatatttcataccaatttccacccttattaaagttaggtttaaacaaaagagctgaagaaacgaactatgaccagtatgctccaaggaaaaccgccagacaatgctggcggctttttgctgcttcgtttatttattaacagagatcgtaacgttatttcctgcaactgaaacctttgcgaaatcctgtgtatctaccacaggagtaacggctttattgtcgatagtgatgttgttaaaagaggtcgaaaaggttgctttgatcgcatcacgctggctttcatacgaaacagccgcggtagcaagggttttccattttgaaatcgtgccgatgttggttccttgaatttctgtgataatccgtccagtatagccgtcattgttcgttccccaaagggtcatgcgcgtattgccgcttaaatttttatagattgtcatttggactgtgcttccagggcggaagcctttattgtatgtgaatttgtcttttccttcgatgtacgtttcttcatttttggacccaaccttcatgaggggcttccagacgttgtattgtttgctgtactgaagcccgatatcggcctcagttccgcttgttgccctaaatcctgaataaatataaggagtagagaccgtatcatattttacagtgtcaggaagattgattttagctgtaaaaacggcgcctgtactattcagataggcgcggccgccgattcccttaggcagctgtgatgctgcttttgcgacttgagcatctgccgcgggcaagcctggtatacctgatggaagtgttccgaaaagaatggctgttcctactgcacttgcaatcaatattttttcactcaaattcccccttttgatagtgatttcgtcatttattataccttattttggaactggattgatgtatataaataaacaaaatatttcattttgagtgatgtaagggacgaaacgcttctccaatctgaaagctatgtaactttatcagaggaaagaacgagatcacaatcgttttaaccgatttgaaattttccccaaaataaaagtacaaatgcttaaagaaacgatcattaaaagaatgcccgctatcgtttcccagcctgtaaaaaagaggtgacgtttcatcaatgtctgtccttgtaaaatgataaaagcacagataccgactaagaaaagaaaacaaatacttaggattgctaacgctttacgtgagtatgttttcatttcatctttaaaatacagcaatacgaaaacaaagcagataacattggctattgttcttatcacctcaaatcttttcatgacaactgatataaaaagacaaagtaaaatgagataaaatacgatgtttctatacaaaaaacctctccttttatgtatgatcctcaaagagtttataaaagtttctttgtaactgcaataaactgaatgcgctcatttatgaactaactaaactatgtactaaatattcattattcttttttagattcagtcaccaaggttttcatagaaagggaagcttcagaaatatacatatagtgcataaacaaaaaagacccggcaatagccgggggaaagtaaaaacgaggagatgtgaatggcgtttagtagtgttttttatgctttttatactctacaacataatcatagtcttttttatcgtgatcataatattttttatcataatcatcatattttttgtcgtaatcacagtcataatattttttatcatattcgtaatacttcttataatacgtttttttgaccgtataatactcttctttgtattttttgtaataacccatatttactcctcctttatttttactacgctttattatacggcgagtagattttgcggcttggacagttaaaatcatagaaggaaaaaagggctgtccaaatgataaaaaaaaggcagatgacacagaaacaaatcaaaataaagagccgatttttcatcggcccaaacgatttatcctatatttgtttgtcttctttgttttctgagtcactttttctgatatcctgagtcagtccgcttgttgcttgtttaaattctgataaggcttttcctgctgcacggccaagcgctggcagtttatcaggtccaaatactaaaaaacctacaaacaaaataacgagtatttttgtgaagcttaattccatatccttttccccctgattgaagtacaaccttttaaacaaattataagagatagcagtacaaatgggaatgcatttatttttaacattttaaaaccagcacaaagacggattcataaaacggctgctgctgaatataatgtccaatgccacctgcctaagaagcagggaggcaggatggatcaattatgtagctctgccggaaatgatacaaacgtatctgcggctatcattgaaatagaggagtggtgtagctgatgagattcactaaggtagttggatttttgtctgttttagggttggctgtggtttttccattaacggtacaagcagaaaaagctggaactgctggggctggagagtgggataagttggggacttacacatatacttactcaagtccgacggtatactcaaccggaggagattttagagtgtgcctttcaggaagcactcctttttctgtctcactgcacttatatgaggatgatcccggtgacaatcctgatgattatgtaggggcaaactatttttcacccggagaatgccacacatttggcagtattggaaaatttgtagatgggagcaataacaaggccgagttctatgttaccgattactctggtaaatctaaaactgttacgttttatgattgatggactcaaattgtgaagtataacccttgggaaagaacaaaaaagagagatacctctctcttttttatgcttcgacagccttacgaagcctttcatttacaatgccagtccagccgccatccatcttgccgcgaacgacggagcttttctcgtttgctttgccgatcacttcattcggctctttccagccgctgtgaataagggtaaaccctgtcttttcccccaagtcttctaattgaaaggtaacgacccatccttctgtatcccattcaaaagaaagttcagttggagcttgaacagccaaaactttacaaggggacggcccaaacggtgattgtaagtgaaattcttgtccttctttgagctgaaagtcattgggcataaaccacttggcaatgccttccgaagtagagactgtctcccagactttctgaatgggagcctccagggtaatgctttttgtaatatccggtaatgcattttcgttgttttgagccatttcgtttacctcttgacatatgatgtttttttcaattcaatcatataataactaataagatcatgtccatagcgtgcattatttatgctagagctgctgttgaacagcgtgtcagtcgccagtctgatctgtgaatgggagaattctgcatgcgcgaaaaagagagaggtgtatgttgtcatttcgttcattcttgtttgctcgccgcaactgctatgtttgaaccggaattcctgttcaggcaatttattttgcgatttttgttttaatagtaaatgtgccattttctaaaacaggaggttttttatgcttggaaaaatcaaagcagccattgataacagtccagggaagccggccagaattatagttagtgaaaaagtgtttcagcaattagaggaagaaatgcgctttgtttacgtatccaaaccgaaaacgataatggggattcctgtggaagtttcagatcaggcagaaagcttcaagctggaattttagtttatcccagactgctaaaaggctcattttgtgtttaataatgcaaaatggtcaggttgatttctttaaaagcatgatgaaatgttcatcatgctttttttattgagaaaaaagacgaacataaaaaataggtatacgggaaaaataatcctattagagagaggggaactgacagatggataacatgatatcaacacttactgactggaatgtgtggtttcaagcgttagtagtatttctcgttccatatgcaatctataaagtgtttacttggattcatgtataagaaggtgcaatgatgaggtggcggagcaatcagtacaaaacacagaagcagcataaatcagatcattcaacagctgaaaaggatcaggatgtgttaaccggtaacatcggatacgatttagaacatgtaaaaagaaaaataggacataacggggacgttcacttccgtgagcttgaaatcactcatttacatgtgaaagcggcattgatctttgttgaaggactgtctgatcaggatttgattaataaaggattatcagtgttattcatgaatcaacctaatcaggtaagcgatgaaatttctcaatccggcaaaggtattttaacttcgaaacagataaaaaatcaaatcatatcaatcggtgatgtcatagaatcagagaaaatcagtgatatcgtgttgaatgttttcatgggttcgacagcgcttctcatcgatggaataccgcaggcctttcttctgggaactgtaaaaaaacaaaatcgaagtatcgaggagccgctttcagaagcgcttgtcagagggccgcgcacaggctttacagaagagttgagtacgaatacagctcttttgagacagcaaggaaaaaatgatcaattaacattgcagagatttgaagtaggaacacgattaaaaaaggatttaattatcgcttatatgaatgacattgcagatccaaaagtagtcgaggaagtaagaaaaagagtgagagggattgagatcgatcatttgccggagtcaggctacgttgaacagttaattgaggataattatttgagcccgttcccgcaagtacagagtacagaacgtcctgatcgcgtcataagcggattaatggaaggaagagtagccattctgcttgacggcactccgtttgctttgattgttccagtcactttcagcatgatgcttcaatcgcctgaagattattatgaacggtggttcccgagctcgctcatcagattgctgaggttcatcgcagcaatgataacgttattcgcacccgctttatatatatcatttatttcttttcatccggggttaattccgaccaagctggcgatttcaatttccgggacgcgccagggtgttccgttcccatccctcattgaagccttatttatggaagtcgcgatcgaaattttaagagaagcggggcttcgtctgccaaaaccgattggacccgcaattggcatagttggcggattaatcatcggggaagcagctgtgcaggcggggattgtcagtccaatcatggtcattgttgttgcgctcacagcaatttcttcatttgccatcccgcattatagcacaggtatagcacttcggatgcttcggtttggcgcgatgttttgtgcggcggtgtttggattgtttggagtcattatgtattatctgctgctaagcagccatgtcgtaaagctaaagagctttggtgtgccatacgcaagtccggcagtgccctatcacttaaaagattggaaagactttgttatcagaatgcctcttttagtcatgaagcgccggcctaaaatgatgaatacagataatacaaaacgggtgaagtgatgaactcgacaggatggtgataaagtctcatgttcagcccaaccagtaaaatcacaaccgctcaggcaacgattatcatcattaattatatgcttgctgccggagttcttacgctccctcggacagtaacagaacaaacacaatctcctgatggatggatttcaattttattaggcggggtcctagcggtaatagccgggatgattatagttaaattaagccagcagtatcctaaggagaccttttatgaatactcccgacatattgtaggaaaatggctcgggcatctgatcagtattgtttttattgcttattttctggcactcggtgcatttgaagtcagagtcatgtccgaaatcgtggatttttttctcctcgaagggacaccgtcttgggccatcattatgacagttctttggattgggctttattcaattacacaaggcctagatccgattgcacggctttttgaaatgatttttccgattacggtcatcatctttttaacgatagccctcatgagtttaggcatatttgaaatcaacaatttgcgccctgtattaggagatggaatcatgccggttctcagaggagtaaagacaacgaacctttcatttacatgttcagaaattatgctcattttagtagcatttatgaaaaagccgaaaaatgctctgaaagcggttgtgattgggacaggcgttgtgaccagtttttatatgattacgctgattatggtcatcggtgcactatcagttgagggagttgtgacgagaacatggccggggcttgatctgatgagaagttttgaaatacctggtttaatatttgaacggtttgaatcatttctgcttgtgatttggattatgcagctttttgccacgtttattatcactttttatgcagcttccctgggagtctcacaggtttttaaaaagaaacccctttcatgtatgtttgggctgcttcctgttatttatatcctctcttgcatgccgaaaaatgaaaatgacgtctttatattgggcgatacggtcagtcatatcgctttgtatatatttggcgctttgccgattttgctgttagtcatttcgaaatggaggaaaagaggtgaaaagtaaactaaaacgtcaagtgcctgctatggtcatagtatgtctggtgatggtttgcgtaacaggatgctggagcagccgggaaatagaagatctgggtctcacattcgctatcgcaattgataaaggaaaagaaacgaacactgaaaaagagttaaaagaagagggcgggagctatccgaaaaaagacaacattacgctgacctatcaatttgttaatgaaaaagcggcaggcgcgggcactggcgggggaggcggtagcggacaaggagtgcaaaaagcgtatattaatataagtgaaacaggggattcattacagcagatcggaagtgaggttgcactaagacgggaccgagaagtgtttagcccgcatttaaaagttgttgtcatgagtgaagatgtgctgcacacatttcctatcgacgaaatgctggatcaattttttcgtgataatgaaatcaggctaagctgtcttgttttatctgctaaaggggaagcaaaagaagctctccagctgaaagagaacggagaaattccggcttttcgactgattggattaggtgaaaatgaacataaggtttccaaaattcttccccctgtgacactcgcgaaactaattggaaaactgcattctggcagcagctttttactgcaaaatgtggttgcggcgaatggagcggtcaagtattccggagcagctgtaatcaacggaaaatcgaaaaaaatgataggcactttaaatgaatatgaaactgaggggattacatggattagaggagaagggaaaggcggagttgtcaaaagtcatgataaaaagagccaacagacgttagcgtacgatatcaataaaatcaaaagcaaaattcagccaatcgtaaaagggacggatatttcattccatgtcgatattgaatcagaaggcgatttggttgaaaactggaacacaaaagaggcgttggacacccagtttatagatcgtctcgaaacgactattgaaaacgaggtaaagataatagttggtcaggtattaaaaaaaattcagcatgattataaagcagatgttgcgggttttgatgaatcttttagacttacatatcctcacttatggaaaagggtgaaaaataactgggatgacaccttcagtaaagccgacatcacatacagtgtgaacgtcacaattactcatttcggcacggttaaaactcagtaatgaatcccaaggaagagaaggaaacctctcttctcttttttatgcattttttaggataaagatacattttttggagagatatacacttttcaaatcgaccaatatgctaatataggaattgcttgaaatagaagggagaaggggctgtgaggcagaaaccgatttatgtagaaatcgaaatgaaatctgatctggatacactctgggaatatacacaaaacccatcactgcataaggaatgggatctccggttttcaaatattacgtatttgaatagtcagccatgcgaaaaacagaagtttctttacgaaacaagggtaggctttggattaaaggtgtcaggtacaggagaaaccgtcggtgttttcaacaaatgttcatctgaaaggtcttcttcactggcttttggctctaatcatccgttatctctgattcggcatggaagcggctactggaagtatatacagagagaaaatgggaaaatgacgtttttaacacagtatcaatacaaaacagcctacggactgccgggaagatggatcgatcgtttattatttcggccgctgcttggctgggcgactgcctggagctttgatgcattaaggctttgggttgagcaaaataaacatccgaagcgcttcattcgatctgctatcatctatgtgttcatgtgtctgtttttcagcctgttttggttctatcaaggctttgcaagtgttgagacaagcatattggcaggaacagcggagataggcttagctattttgtggctgattcctttaaaaagaaaatggatcattcatggtgtccaggcttgtatctttgcggggtttgcttgtctaggttccgaaatattcatgtgggttctgttgagtgtgttttccgcagcaagcggcgctcttagcctgcagctccccagtgccaggcgcacaaaacgaaagagaaagaagtgacattgtgagttcgatttatgaaaaatcaattattaactatcatttgctgcatcccaagctgcggaaacggtaccaattagacgggtctcaaacattcagcgggacgggaacgatgtcagaaataagcggaggctcttttctggttagaatgctgttaaagctgggtgtttttttcagatgcttcttttcagaaagaggcaaagacattccatttacaatacaaaatagaacttgtcttttgaaatcgcaacatacaggaatagaatggaatcgtacatttttctttaaaggcaaaaaacgtttctttgacgcgataatgatatatgacgagaaagaaaatagaatacttgatttcttcggcaaacctcatctgctgctgtctgttttgacgttcgaggcatctcatgacggctctcttacgatcacatcgggaaagcaatggctattgatatgcggaaaaagaatcccgctgccgaaatggctgaccggtacatccgaagtttgcgaaacgtttgatgaaaaaaagaattgtttcaccattgaagtgcatgtgcaaaatacaattcttggcactcttttcttttataaaggaacgtttcaggagaaagagagagaatcatgaaacgaaatggcatagtcagtgcgctttgttttataggatttcttgcagcggaagcaccggatatttcagtggcagaggcactcgttttgttatccattctatttttcgtgccgggaatttttccttttgtttttcgtcaatctccggttcgtgctgctcagtttatggaatatgggctaatccagtgctaccctgtagccgcattctttgcagtgttggctcttgtgacggaggttgggggtttcgcacttatctggtggatgtacacagtttttattgcattgtatgcgatcttccgcctttgggaaacaaagatacatagaatcgaagagacatcagttttgttcggtcttatttatttggcgggaggaggattttggttttttgcttatgctgcccatttgcagatcatgcaatttggccctctcatcattttgctgactgctgtccactttcactattctgcttttctgatcccgatcttcaacggcttactcggcagaaccattagaaaacatcggatgttgtatagttggataacatgggtgattttgctttcgccccttcttatcgcactgggcatcacatattcaaaaacacttgatgtcattgcggttagcatttatatggcggcgatttatcttcatgcatttttggtgttcacggcagcttttcgcaccaagacggggacatttcttattcggctttcttccgctgttttaatgataacgattgctttctcgatgatttattcatttggtgtatttcggcaagaagttacattgaccatcaatcagatgatttggattcacggttttgtcaacgcgtttggtgttatcttgcccgctctcatagggtggagaatagaggatccgaagccttttgatgcagacagtgtaaagacattcagccgtatctacggaaaaagaaagatgggagaagaatttttagctaacattcaagctgaaaataacgctcggtacagcggacttgtggatgatatgggcagcctgcgttcaaaagatttttcaccagaaaaactggcgccgctcattctttcgttttatgaacaaaccatcgaatataatattaaagcaaaagtaacatggagcacgtggtttcggccgcttgcaattatttacgaatggttcagcagaagaatcggccaaatacatctttcgacgtaccctgactggtacaggatgtacagcaagataaaaggtgttcattctaaaaaagacggaagggaaagagtacgtgcctggattagaacaaatgaaaaaaacgaaaccatttttaccgctctttattcagtgtatcgttcaaatggagaagggtatatgaatatttctttaccgcttccattcagcagcatgacaggtattttaaaaccatatcatcatcaggagaagctggttttaacaagcaggcggagaaaaagcagagcgggggatgaggggatttatctgcaaacaagagcgggaacttgtccgcttcctttatctgaaacctttctgatagaagctgtacatgacaacaaattaaccgctgttcatcatatgtggctgtttggaataaaatttctaactgttcattacagcattacacatattaaccagcctattgaaagaacctaacacaaagaagaagcttcgtctgccagttgtaatgagatgaactgttttaaaattctgcaccgcataaagacaggaaaggaagggtttatggtgttttatatcagtttatttctgattctttggctggctgctgggtttgcagtgggaatgaaacaagtgtatgtcgatcagctgtttgataaagctgtgatcgaaagactggaaaaagaagcgaatgatcatggacatgctgaccggatgatcaaacagcgcgtcctttatattgcagcagtgacagtaagcgggtttatttctgtttattatgaaatgaaaacaatcccgcaaaggcgaaacataagaaaaattgaaaaaaacatcatgaaattaaatcaagcaaaaaaacgaagaatgaagaaaaaataaaaagtgcacaggccaaagggcaggtgcatttttgttttgtatggaaaatgggggaggtggtgccagcttacttttcataaattcaaaaatgagaagaacagcgcccgggctaatggtatataatattgtgaatttaacaaaaatttaacaaggaggacgagagaattcgtgctaaagcctcaaagagacctacattctgttgatttggacttagaggcggagtagatgaaaccggccaaagtatccctgctccgccgtttgctccattccttgaagcatgttgattgtaacatagccaaacgttttccatcaactattaaaattgtaaaattattgttgatttttatggtgtttactccgatttcttcaatttatgctgaagatgtatatcagaattttgaggaattaaaaaacaatgaagatccttctgattacggcgttgttacgaaagaaaccggaagctctgttcttgttttagctattcacggaggaggtattgaaggcgggacaagtgaagtagcgagagagctcagcaaagagtactcgatgtatttatttgaaggcttaaaatcgacaggaaactcagtcctgcacattacgagcacacactttgatgaacctcgggcccttaaaatgacgggaaatcatgaatatgtcatttcattacacgggtacgcagaagaagatcagcagatcgaagtcggcggtacagatcgcgtaagagcggcagatttagttgagaaattgcagcatgccggttttcctgctgtattgctcaatatggaccatccgcatgcgggcgttagtccgaataacattgcaaataaatcaaaaacaggtttaagtattcagatagaaatgagcacagggtttcgaaagtctttgttcggcatcttttctttaaaaagcagagctgttactcaaaatgagaggttttatgagtttacagaagtgatgttccgttttctcaaaaatagctactgaaaaataggaggcgataagacagcctcctattccttatgcttctctttcgtttcgggaaacagctcgtccgcggcttccgtttgatactgcaacgtgttatctctcgctgacagttcatttcggaaattttcatcaagcacatttttcagtaaataccgatgaaaaaagtattcaaaaacagtaagacaggcagcggaaaggagagctgctccaaatggtgagaaatcgtttcttgtttgggttaaaacaaatacccaaagaataacgaatgaaaggccaaagtcagctaatgaagctgtaatattgtttgttctgggtaagacgagcatgtcaccagaaagataggaaacaaaacctaagaaaagtgcaataaacatcacacttaaaaaggatgcgtgatagactctgtccaaaatcacatataaaagggcgagagtgaaagcaatctttgaagcaagcgcaatgatatgtttcatttgaccacctaaattgttattttttgaagaaaattcttgggcgtaaacaaacgataaataatgcaattcaaaaccattcataatggtcatgttactattttaaacagtccgtttttgtttacactggtattttttttcagctgtatgaaactttcttatgaaaaagtcgtatatgtggatgatcagctttcaagggggaatgatttgtggagataaaaggaatcaatcacttgctattttcagtttcgcatttggatacatcgattgatttttatcaaaaagtgtttggtgcaaagcttttggtaaagggaagaacaactgcatattttgacatgaacggcatctggctagctcttaatgaagaaccagacatcccgagaaatgacattaagctttcttatacccatattgcttttacaattgaagatcatgaatttgaggagatgtcagctaaattaaaaagacttcatgtcaatattctgcctggcagagaacgagatgaacgcgatcgaaaatcaatttattttaccgaccctgacggccacaaatttgaatttcataccggaacccttcaagacaggcttcgatattacaaacaagaaaaaacgcatatgcacttttatgatgaaacggccttttgatagcacaaccatatttcatataaggttaaatttaaagaagggtgttggtggagactttatgtttggggaaggtttctacccgacttgttcaacgatgccatatattttgaactgtacaagtgattgggtgaaggtgaaattgaaatacacattacattttatatgaagaaagcgagctgttttatcagaatgttgaactaattaaactatgtactaaattttcagtatatttcaattgcttcgccccttaataaatatgaaaccgtatccttccacgacctaaaaaatgaaacgtttttaagaagatggcgtctaatattctaaatgttcatattttgataaaagtttcctaaaggaaagaaaatttcttgacttcaacaatcttttggtggataattatggtgtaaacatgatgttctttttcctcctattcgggctcgcacccaaaagtcagggcgagcctgctttttttgaacaacaaaccccctctccgtaaaggaagagggggttattttatgcatctgatagatcaatagattaatggacggttctgaacacgccaatcactttccctagaatgctgacattctgcaaaatgataggttccatcgttgggttctcaggctgcaagcgaatgtgtgtatcctctttatagaatcgttttacagttgcttcatcatcttctgtcatcgcaactacaatttccccattgttcgctgtgttttgctgtttaacgatgacatagtccttatcgagaataccagcatctatcatactgtctcccataatctccagcataaatacatgctcgtctggaggaaccatgcggtcagggagcggaaaatattcttcaatattttctactgctgtaataggagatcccgccgtgactttcccgatgaccggtacattaacgacctggctttgcggaatgtctacttcttcatcaagaatttctattgctcttggttttgtcggatctcgtctgatcagcccttttgtttccaagcgggccaaatggccgtggacagtagaactggacgcaagcccgacagcctctccgatctctctcacggaaggcggatatccttttgatttaacctctgctttaataaaacggaggatatcaagttgcctttttgatagcttcgtcatttttcgcacctcaaaacgtcgattttaagaagattatagcatgattttccttacagtacaaacataggttcgaaaaaacaattgacagaaacgtttgttcgtatatactgaaattataaaaatgcgaacaaacattcctgttggaggttatgatcatgagtaaagaatctattatttttgtcggtctgttcacagtgattttgagcgcggttatctttatgctgtcatatacaagcagcggccaggagcttaatcagtatgttaaaatagaagtccagcaaggcgacacactttggtcaattgctgatcaggtagcagatacaaaaaagataaacaaaaatgattttattgaatgggtagctgataaaaatcaactacaaacatctgatatccagccgggtgatgagttagtgatcccattgaaaaagaagcatcaggatgcatatgaattggcaactgtaagatagagaggaaagagagataaaatgaaagcactcatttatgcccgtgtaagcacaaataaagaacagcaggaaacgtcattaaagcggcaggaagaggagcttacggccattgctgcggagaacggcatggaagtcgtcaaagtgatttcagaaaaagccagcggatatgaaatggatcgggatggtgtatttgagctgcttgatgagattaagatcgctggaattgatgtcattttggttcaagacgagacaaggctcgggcggggaaacgcaaaaatcgcactgcttcattgtatttacagagaaggtgtgaaagtctatacaacggctcatagaggtgaactggagttatcggaggctgactcaatggtcttggaaatcgtcagcattgtggaagagtatcagcgaaagattcacaacatgaaaatcagacggggaatgaagcgtgcagtaaaaaacggttttaaaccgcaaaaaaacttaaaaaaccaacatgagaacagtggaaaagaaaaaatagaggtgccaatctctgagatcgtccgcctaagagcgaataaactaacgtttgctgaaatcgcggctaccctaagagggtttggctatgatgtctctaaagcaaccgttcaccggcgttttcaggaatacatagagaaagaagagacagcagagtgaatcagttgtaaaactttttttgatctagtactatatagacaaaatgcaataaaggagtttaacatgatttcaaacgcgaaaattgccagaattaatgagcttgctgccaaagctaaagctggcgttattacagaagaagaaaaagccgaacagcaaaagctccgtcaagagtacttgaaaggttttcgttcttctatgaagaacacgttaaaaagcgtgaaaatcattgacccagaaggcaatgatgtaacaccagaaaagctaaaaagagaaaaaagaaatagcaaacttcactaatataagaggaatacggcaatatcgtattcctcttttgcatatactataatcaaaactcttatgtgacaaaattcaacaagtttctctcaaatttaagctgaaacagttgagaaaaagtcgtcagacatttatgatgtaagggtacaacacataaggaaggggatttttatggatacaattgaaaagaaatcagttgctaccattcgcacactgtcaatagacgctattgaaaaagcaaattctggtcacccagggatgccgatgggagccgctccaatggcatacacgctgtggacaaaatttatgaacgtaagtccggcaaaccctggctggtttaaccgtgaccgttttgttttatctgctggacacgggtcagcactattatacagcatgcttcatttaagcgggtttgatcttagtattgaagatcttaagggattccgccagtggggcagcaaaacacctggacacccggaattcggacatactgccggtgttgatgctacaacaggtccgcttggccaaggaattgccatggcagtcggtatggcaattgctgaacgccatttagcggaaacatacaaccgcgattcatttaacgtagtcgatcattatacatacagtatttgcggtgatggtgatttaatggaaggtatttcttctgaagccgcttcactcgcaggccatcttcagcttggccgtctgatcgtactatacgattctaatgacatctctcttgatggagacctcgaccgttcattctctgaaaacgtgaaacagcgttttgaggcaatgaattgggaagttctttatgttgaggatggaaacaatattgaagaattaacagcggctatcgaaaaagcacgccaaaatgaaaagaaacctacattaattgaagtgaaaacgacaatcggattcggttcacctaaccgtgccggtacatccggtgttcacggtgcaccgcttggtaaagaggaaagcaaattaacaaaagaagcttacgcgtggacgtatgaagaagacttctacgttccgtcagaagtttatgagcatttcgctgcagctgttaaagaatcaggtgagaaaaaagaacaagaatggaatgctcaattcgctaaatataaagaagtttatcctgaacttgctgaacagcttgaactggcaatcaaaggagagcttccgaaggactgggatcaagaggttcctgtgtatgaaaaaggaagcagcctggcatcccgtgcatcttccggtgaagttctcaacggacttgcgaaaaaagttcctttctttgtcggaggttctgctgacctagcgggatcgaacaaaacgacaattaaaaatgccggtgattttacagcggttgattactcaggcaaaaacttctggtttggtgtacgtgaatttgcgatgggtgcagccttaaacggtatggcgcttcatggcggtcttcgtgtattcggcggaactttctttgtcttctctgattacctgcgtcctgcgattcgccttgcagcgttaatgggccttcctgtgacatatgtcttcacacatgacagtattgcggtaggtgaagacggtccgacgcacgagcctgttgaacagcttgcttcactccgtgcgatgcctaacctttctttgatccgtccagcagacggaaatgagacagcagcagcatggaagcttgcagtgcaaagcactgaccacccaacagcgctagtgcttacacgtcaaaaccttcctaccatcgatcaaacatctgaagaagcattggcaggagtagaaaaaggtgcatatgtcgtttctaaatctaaaaacgaaacacctgacgctcttctcatcgcttccggatcagaggtaggtcttgcaattgaagcgcaggctgaattggcaaaagaaaatatcgatgtttctgttgtcagcatgccttcaatggaccgttttgagaaacaatctgatgaatacaaaaacgaagtccttcctgcagatgtgaaaaaacgtcttgcaattgaaatgggctcatcatttggatggggcaaatacacggggcttgaaggtgacgttctcggcatagaccgattcggtgcatctgctccaggtgaaaccatcattaacgaatacggcttctcagttccgaacgtagtgaatcgagttaaggcattaatcaataagtaagcttttgaaagaggatgagtcaaatcatcctctttttcttgtttatccgacaaaaatagtattggcggtttaacagtaatagacaattctttcttttcttcttttgtataatagagagcaaatgaaatgctgctggaaaaggggatgaaaagatggaacgtcactactatacgtacctgatcaaagaggaatttgccaatcactatttcggccgggaatcggttatgtttgagctgtttcaagactatcattggacaagccttgaaaagcagcagtatgaaatgacagagaaacagattcaatatattacacaaccaatcccgattttacatatgcatcagcggttaaaaatgaatttaaacaagacggattacaggcagctggattatatttatagaatagctttgccgaaagcaaaaggccacgcgacgtttatgatgaaggagcacatgatagaaattgtggcttcgggagattacgaggcagaaacgatattctttgaagtgttaagaaaagttagcccttgctttttagcaatggatttcaattcgaagcgttacggatggctaaatccggtgaaagaaagaaattttgtctaaaaccgaagaaaaagagatgtaaatgttgtataatagcttttggtttagtacactttaaactagacaacatgaaggaggaaataaaatgactttatgggttggcatcctagtgggcgttgttgcattgctcataggtgttgcactcgggttttttattgctcgtaaatatatgatgagctacctgaaaaagaatccgcctattaatgaacaaatgttacgcatgatgatgatgcaaatgggaatgaaaccttctcaaaagaaaatcaatcaaatgatgaaagccatgaataatcaaacgaaataatacgtaaagattatgatatagagaaacatggttataaaataaaaaacccttatacgggttttttattttgcaatcattcatcacccgctactgctcgaaggcgctgcttttgatattgtatgagaagatggtcaagctcctgactgagctctatcgtaatatgagatgtcattccgttcgccatgacaatttgcagcagctctgctctttttttttcaatttcttttaatagatgctctctaatcacagggatgtatcctttcatacattagatcttcaaagtgaatgtttatattatatccatatttatactaattttcaaatgagaaggagtataatgtctcaatgtcaaattaaattatataagttttttctgaaaatagaaatccttcaagtgaaagtgttaaaaaaatgaaatgattttgtcataacttgaaggaatgtcaaatcatgaagggatgatgacatgggagacgtgaattattttttgacattcggagcggggtttttatcctttatttcgccttgctgcctgccgctttacccagcttttttgtcatatattacaggggtcagcatggacgatgtaaaaacagaaaagctgctgctgcagaaaagaagcctgtttcatactttgtgttttttgcttggcttttcagtcatttttattgctttaggctatggaacatcttttattggcagcctgtttagggattatcatgatgcgattcggcaaattggcgcgttgcttattattttgttcggtttcattacactcggtgtgtttcggcctgaggctatgatgaaagagcggagaatccattttaagcataaaccaagcgggtttttagggtcggtcttaatcggaatggcatttgcagctggatggacaccatgtaccggtccgatattaggtgctgttatcacacttgcaggcaccaatccgggttcagcggtgccatacatgatgttatatgtactcggttttgcggtaccgtttcttttattgtctttttttatcacaaagctgaagtggataaggaagaaccagcttttcattatgaaagctggcggcgttttgatgattgtgattggtgtgctgttattctttaattggatgagcctgatcattattttgctgtcagatctttttggaggctttactggtttttgacggtaaattactttcgtactactactaatccttttgtttttggtacaataagactattatctgaggaaatcgattgttggaggggaatatgacaagagttttagttgtagacgacgccaagttcatgagagtgaaaatcagagagatcttggaagatgcaaattacataatcgcaggcgaagcggcggacggtgaacaagcagcggacctgtataaaaaactgcgaccggaccttgtgacaatggatattacaatgccggtgaaaaacggcataaaagcgcttcgtgatatcttaacctttgatcctaaagcgaaggtcatcatgtgcaccgccatgcgccagcaaagaattgtaacggaagcaattgagctgggggcaaaggattttattgttaagccgtttgaggaaacaaaagtgctggaagctgtaagccgcgttatgggacattaaagtcatttcttttcaaaatggttttttttattgttttggagtatagtatatagtatcaacactccgagaaacaaaggaatgataagtatgatgattatagtttcatcgattattgctatgttaatggctgtagctgtgatggtggtcagaataaagtcctctgacaagcctgtttcaccaaaaaaaatcattcttccgccgatttttatgagtacgggagcgttaatgtttttatttccggtattttgggtaactggtgcagagtttttggaagcattcactttaggtgtgattttctctatttttctaatcaaaacttctaagttcgaaattaaaaataatgaaatttacatgaaacgctctaaagcatttgtttttatattagtcggtcttttggtgatcagaatcgtgatgaaatccatcttgagcacatcaatcgattatggtgcactgagcggaatgttttggattctggctttcggtatgattgtgccttggagaatcgccatgtatttatcatatcgaaaacttcataacgagctgcagtcagctaatattcaaatgaattaaaaaacctttcctcttgtcaggaaaggttttttatttgagaagggtctgataaggttccaaatcgatttttttgtcccgcagatgcctttttaagaaggtatggtctcttttaggagttgcgagaatatagcctttgatcataagttgctgatcaatctttgctaccttttcttttaatgcaagctcaccgattttgcctgcgattttagcttttgctgcatctctgaacagttctggcaccggcgcagtcaattcatctagaaactgtttgttttcatcgttccataaatgtctgctgttttcaatatagtaatcctgccaatcaagctctgatctgccgtcctcttttggtaaacgctttaaaaactttcgaaacatgaaaaaaccgccgattgataataagactaccatcatgatcacccaaaacagaataaaccataaaaaccatccttccagcatcaagcattcccccttattctaaccatattgtatacgaagagagattagaagaacacagtaaaaaaagaatagaaaaaagtgatagacgtctagtcaaaagagatagtagatcatattctattgtatagtgaatctgctatttggccatgggagagtcactagagggtatttgacgataaatggacggaaaaaaaaagtcactttcatagtaggggatgaaagtgactttttatgtttagctgagaggaaattgaagagaaaaagaagagccatcttctgtttctttattgacggcgactgtgagtatttgattttcgcattcggcttgaatggttttgtcattaaaataaaaaggaagcatcatttgtttttcaaaagtctgtcctgacgatttgacagttaagatgaactcgcatccagaaagggtaactgttacttgtgtaggctgtaaaaaagtcagatccgcttctataatatactgctgactagtttcatataaatcaataggcaatgtttcgtcgtaccaggcgaaggggtcttcaaaaaattgccgaagccattcatccatactatcgaaatcatttgcatcgttgcgttttgaatggtccatggaagcattcctccacatatcaaccttgctttacatcatatgcggtggattataatgggtgaacgcataaaaaaacagacactaaggtctgcttttcttacatatcatggcttgagttgtgcttttgtcttgtatggtttcggttctttacttttttgcttccgcttagaggctcaggttggccgggattgtgtcctttaggggcgtttttatgcatatctttacttgtattcttattggtcataaaatgagaacctccttaaaagagttctgtgttattgattggtttttctttttttgttattttggcgttctgcttcagtcagtacaagctggtcgttttcaatatagccggcgcctttgccttggctttttgcgtcattcattccgttaatgacgtgattcgcttttcttttgaccatcattatcacctcaatcataatatggctccttttattgtgttatatgagagagcgtaaacagtaaaaattaccggtacatttttctcataagtcgaacttattgtatttaataaaaacattgatatttacttatgtatgattttgttttaatatgaaattgtgagaaaattgtgatggaatgtaatgttcatctgagaatgatctgatctgaagggggattttggagaatggcaaacgagcaaaaaactgcagcaaaagacgttttccaagcgagaaaaacgtttactacaaatgggaaaacatatcattactactctttaaaagcgttagaagattcaggtataggaaaggtttcgaagcttccttattccatcaaagttcttttagaatcagtattgcgtcaagttgacggcttcgttatcaaaaaagaacacgtggaaaatttggcaaaatggggaactgccgaattaaaggatatcgacgttccgttcaaaccgtctcgtgttattttacaagacttcacaggggttccggcagtagtagatctggcttcactgcgtaaagcaatggcagctgtcggcggagatcctgataaaatcaaccctgaaattcctgttgatctcgttatcgaccactctgtacaggtagataaagctggtacagaagatgcattagcagtaaatatggacttggaattcgaaagaaatgcagagcgctacaaatttttaagctgggcaaagaaagcgtttaacaattatcaggcagtgccgcctgcaacaggtattgtgcaccaggtcaaccttgagttcttggcaagtgttgtccatgccattgaagaagacggcgagcttgtaacgtatcctgatacgcttgtcggaacagactcacacacaacaatgattaacggtatcggtgttctcggctggggtgtcggtggaattgaagctgaagcgggaatgcttggacagccttcttacttcccagttccagaggtaatcggcgcgaaacttgtcggcaagcttccaaacggaacaacagctactgacttggcgttaaaagtaacacaagtgctgcgtgaaaaaggcgttgtcggtaaatttgttgaattcttcggaccgggaattgctgaactgccgcttgcagatcgcgcaacaattgcgaatatggctccggaatacggtgctacatgcggattcttcccagtagatgaagaagcgcttaactacctgcgcctgactggccgtgatcctgaacatattgatgttgttgaagcatactgcagaagcaatggcttgttctacactccagatgcggaagaccctcaatttactgatgtggttgaaattgacctgtctcaaattgaagcaaacttatcgggtccaaagcgtcctcaggatttgatcccgctatctgctatgcaggaaacgtttaaaaagcacttagtcagccctgcaggtaaccaaggattcggtttaaatgctgaggaagaaaataaagaaattaagtttaaactccttaacggtgaagaaacagttatgaaaacgggtgcgatcgccattgctgcgattacaagctgtacaaatacatcaaacccatacgttctgatcggcgccggactggtagcgaaaaaagcggttgagttagggcttaaggtgcctaattacgtgaaaacgtcacttgcaccgggttctaaagttgttacaggatatcttgtgaattcaggccttcttccatacatgaaagagcttggctttaacctcgttgggtacggctgtacaacatgtatcgggaactcaggtccgctttcaccggaaattgaagaagcggttgcgaaaaatgatcttctgattacgtctgtcctttccggaaaccgtaactttgaaggacgtattcacccgcttgttaaaggcaactatcttgcttcaccgccgcttgttgtggcatatgcgctggctggaacggtaaacattaacttgaaaaccgatccaattggtgtgggcaaggatggtcaaaacgtatactttaatgatatttggccgtcaatggacgaaatcaatgcacttgttaagcaaactgttacgccagagctattccgcaaagagtatgaaacagtatttgatgacaacaagcgctggaacgaaattgaaacaacagatgaagctttatataaatgggatagcgagtcaacttacattcaaaatccgccattcttcgaagaaatgtctgttgagccaggcaaggttgaaccattaaaaggtttgcgtgttgtcggtaaattcggcgattcagtcacaactgaccatatttctcctgcgggggcaatcggaaaagatacgcctgccggaaagtacttgcaagaaaaaggtgtttctcctcgtgactttaactcctacggttcccgccgcggaaaccatgaagtcatgatgagaggaacatttgcaaacattcgcatcaaaaaccaaattgcaccgggtacagaaggcggatttacaacgtactggccgactggtgaagtaacatccatctatgatgcgtgcatgaaatacaaagaagataaaactggtcttgttgtattagcaggaaaagactatggtatgggatcttcacgtgactgggctgcaaaaggaacaaaccttctcggcatcagaacggtcattgcagagagcttcgaaagaattcacagaagcaaccttgtattcatgggtgtgctgccgcttcagtttaaacaaggtgaaaatgcggatacactcggcttaacgggtaaagaagtcattgaggtagatgttgatgaaacagtccgtcctcgtgaccttgtgactgtaagagcaatcaatgaagacggcaatgtaacaacttttgaagcagtcgtacgctttgatagtgaagttgaaattgattactaccgccatggcggcatccttcaaatggtgcttcgtgaaaaaatgaagcagtcctgatgaatcaataggaagagaaggcatttcgctttctcttctttttatgacacaatgtgctgcggaggtggcatatgctgaaaaaatggctcgcagggatcctgcttatcatgcttgctggttatacgggatggaatttatatcaaacatacagcaaaaaagaagtcggaattcaagaggggaaacaagcacctgattttactttgaaaacgctgtcaggagagaaaagctctttacaggatgcaaaaggcaaaaaagtgctgctcaatttttgggcaacttggtgtaagccgtgccgtcaggaaatgcctgcgatggaaaagctgcaaaaagagtacgccgacaaacttgcggttgttgcggtaaatttcacttcagctgagaaaagtgagaaacaggtcagagcgtttgctgatacgtatgatttaacgttccccattctgattgataaaaaagggatcaatgctgactataacgtgatgtcatatccaacgacatatatcttagatgaaaaaggtgttatccaagacatacacgttggcaccatgacaaaaaaagaaatggaacgaaaactggatcttgattagattcagtttttttatgctcaaatatgcttacaagttttcagaattggaaaaaataaaagaatatgcggaggtgagaagcgtgaagaagatgagaaaacgttcttttcatgagctcgtcatggaaaacaaaaaagagctgatgaccaatacagagtatttaaatcagcttgaggaaaagcttgaacagcgatttaagcaaaaataacctttaatttgtattcatgtttacccctccttttgagaaacctatctgttgaggagggataaacatgggaaacaacaagaaaaacggtcagcctcaatatgctccaagccacttgggtacaaagcctgtaaaatataaagccaataaaggggaaaaaatgcatgatacttcaggtcagcggccgatcatcatgcagacaaaaggcgagtagcgaaaaatcgagtttatttctaggaggtacatccgaatgacaaagaaccaaaatcaatatcagcagcctaatcctgatgatcgctctgacaatgtggaaaaattgcaggatatggttcaaaatacaattgaaaatatagaagaagcagaagcatcaatggagtttgcttcaggagaagataaacagcgtatcaaagaaaaaaatgcaaggcgcgaacagagcattgaagcgtttcgtaatgaaatacaggacgaatctgcagcgagacaaaacggataccgttcttaaaaaaccagggaaacctggtttttttctttctgatttgattatggtaaaatggggctaaattgacgttaagggagcagagtaatcttgcatgtatcaaaaaaagaaatagaagtgcgttatgcagaaacagatcaaatgggaattgtttatcacgcaaattatcttgtgtggatggaggtcggcagaacggccttaattaaggacttaggctttttatatagtgatatggaaaaaagaggcgttctgtccccagtcgttgatatcaacatttcctataaaaagccgcttcattacggagaaaccgcggttgtacatacatggatagaggaatataacggctttaaaaccgtctatggttatcacatttataatccggccggtgagctttccatcaaagccacctcatctcatatttgtgtggataaagaaagctttaagccaattcaattccgcaaagcttttcctgattggcacacagcatatgaaaaggccaaaaaatagggaagtgaacgggatatggcgtttggtgtgaaacgggaggaacttaaccggtggaaacaagcagtgaaaagaggagaaatcgcttttttaacacattactggctggatgaccgatttccagaagcaaggactgtgacaaaagccggctgtgcagacattgataagctggttcagtggggagcggcgtacgggttaaaaaaagaatggctccataagaaaagtgaatttcctcacttcgatctgctgggggaaacacaaaaatatattttggaacaagaaaacctaaccgatcatctaatacgatttcatttgtaaaaaaagaacgcacatgatgtgcgttcttttttattggtattcaaaaaccggttcatcagcgtcttctgaatagctgacgagaaggtcgtggttatcaaagtaccataaatcactttcttcaataaagaaggtaatgccgtcagcttctgcagtgactccagcctcttgtggcgcatctttcgctacaccgagagaaaaacccttttgaacgttgctgcagcctccatagcggacgaaaaagcgaacctggtctccgctttccaaatcgagttcttctttataccagttcaatgcgtcttcgttaattgtcatattcataacagaacacccctttgttcttcatttgaattttctctattataaacgtattaggctattctgtgtcaaaagagaagttttttaagcttataaccattttactttaggttctgttttattgataattcgtttaatgttcgctcggtgtctgtatatcacaaaaatagtgagcagggtaacgacaatcaataaatacgtatcatggacaaagaaactatatataacagtatagatccctgttaacatcgatgagagagaaacaaatttagtcaagtataaaaagatgaagaataccgcaaccatcgtgataaataacaggggtgcgtaaaatagcaaaacgcctcctgatgtcgccacggctttaccgcctttaaatttggcgaagatgggaaacacgtggcctaaaaccgcaaagactcctgcaagaagcgggtgaatatcaacatgcatgagaaaaggcaatgcagttgccagtgtccctttcaaaatatctccggctatgacgaccgaaccagcttttacacccaatgtacggaatgcattggtagcgcctaagttgccgcttccgtgctcccgaatatcaattcccttggcaagcttgcccacaattaagccagatggaatgctgcctatcaagtaggccaaaataatcaataaagcaattaacatctacatttctcctttttcaaattcccttctttttattttaacatgagatgtcatgatctgatgataagtttttttgtaaagtttgcttacaaatccaatcaaacatgcatcatattttgatttctcctgttttgatcgtgtaaaataagtggaaaaggagtgacacacgatgcaaaacccttctaaagcggaaattaaagagattcttcaaagaagcaaacgtatagccgtagtagggctttcagaccgtccggatagaacatcacatatggtttcaaaagcaatgcaggacgcgggttatgaaattatccctgtgaacccgacaattgatgaggcgctaggtgtcaaagccgtttcatctttaaaagagatagacggtccgattgacatcgtaaatgtattccggcgctcagaacagcttcctggagtggcggaagagtttttagagacagatgcgccagtcttttgggcacagcaagggctagttaatgaagaagcataccagatgctaaaagaaaaaggcagaacggttatcatggatctgtgcataaaagtggcacacgctgtaacaaaataggtgcagaactgcaaaaatccttgtaaattcaaggatttttgctttttaattttaagatattgtttgcgtattacggtgaaacagatacaataaagcttgaacagctttttttgaataccttgtccagctgggtttcggccgttcgatttgcgaaggtctgctgctttatatataataaacaaacatacgttctcatggtgtaaaaacagcactagcctatgttttgagaagaactgattcgttagctctatgttgcgattgcaaacatattggttataatgaggagtccaaggcagtactggctcgaggcgaggtttataaaaaatatcttatatacaaatgatgtgtaacactgaaaaagagaaagacaatgttagtttttgaaaggggtttgtacgtttggctagaaaacagcaatttgattacaacgaagatgccatacaggtgctcgaaggccttgaggctgtcaggaaaaggccgggtatgtatattggctctactgacgcgcggggtttgcaccacttggtttatgaaattgtagataactctgtcgacgaggtgcttgccggccatggagatcacataatcgtcaaaatacataaagacaatagtatttctgtacaggatagaggccgcggcatgccgaccggaatgcataagctcggcaaaccaacccctgaagtgattttaacggtgcttcatgccggagggaaattcggccaaggcggctataagacaagcggcgggctccacggagttggtgcatcagtcgtgaatgctttatctgaatggctgacggttaccattgagcgggacggttttgtctatcagcagcgatttgaaaatggaggaaaaccggttacatctctcgaaaagatcggcaaaacaaaaaagacgggaactcttacacactttaagccagatccaacgatgttcagcacaaccacttataattttgaaacgctctctgagcgcttaagagagtctgcgtttttgttaaaaggactgaaaattgagctgattgatgaacgcaatgaccagcgtgaggtcttttattatgaaaacggcatagaagcgtttgttgcttacttaaatgaagaaaaagacgtcttgtctgaagtggtctcgtttgagggtgagcatcattctatagaagtggactttgcgttccagtttaacgatggttattctgaaaatattttgtcgtttgtcaacaatgtcagaacaaaagacggcgggacgcatgagtcaggtgcaaaaactgcaatgacgcgtgcttttaatgaatatgcgcgaaaagtggctttgctgaaagaaaaggataagaaccttgaaggcaccgatataagggaagggctttcagccattatttctgtccgcattcctgaggagcttcttcaatttgagggacaaacaaaaggaaagctcggtaccagtgaagcaagatcagcggtggatgcgattgtttcagagcagcttgcttactttttagaggaaaatcgggacaccgcaacgcttcttgtcaaaaaagcaatcaaggcgagccaggcgcgcgaagcggcacgcaaagcccgtgaagaagcaagaagcggcaaaaaacgaaaaaaatcagaagcgactttaagcggaaagctgacgcctgcgggttcaagaaacccggcaaaaaatgaattgtatctcgttgagggagattcagcaggcgggtcagccaagcagggacgagaccgcagattccaggcggttctgcctttacgcggtaaagtcattaatacagaaaaagctaagcttgctgatatctttaaaaatgaagagatcaatacgatcattcatgcgatcggcgggggagtcggggcagatttctcaatcgatgacatcaactacgacaaaatcatcattatgaccgatgccgatactgacggcgcccatattcaagtgctgcttcttacctttttctatcgctatatgaaaccactcattgagcatggcaaggtgttcattgcgctgccacctttatataaggtcagtaaaggaagcgggaagaaggaaatcattgaatatgcatggtctgatgaagagatgggtgatgtcctgaaaaaagtcggcaaaggctataccattcaacgatataagggtcttggagagatgaacgcagaccagctgtgggaaacgacgatgaatccggagtcccgcacacttgttagggtcaaaattgacgatgcggcacgtgtagagagacgtgtgacgacgttaatgggagacaaagtagagccgcgcagaaagtggattgagaaaaacgtcgctttcggcttagatgaagaaagcaatattttagaaaatgaaaacttatcggtcgctgaggaggtttaatgattgtcacagccagaattatttcatgatttaccattagaagaggtgatcggcgaccgttttggacgctacagtaaatatattattcaagacagggcgctgcccgatgtgagagacggattaaagccggtacagcgcagaattctgtatgcgatgcatacagatggaaacacgtttgataaaaacttcagaaaagcggccaaaacggtcggtaacgtcatcggtaactatcatccgcacggtgacagctcggtttatgaagcaatggtgcggatgagccaggattggaaagttcgtaatgtgttaatcgaaatgcatggaaacaatggaagcatcgacggagatcccccggcagccatgcgttatacagaggcacgattatctccgattgcatctgagcttcttcgggatattgacaaaaacacggttgaatttgtgccgaactttgatgatacaagcaaggagcctgtcgtactcccggcgatgtttcctaacctattggtcaacggatctaccgggatttcagcaggatacgcgaccgacattccccctcatcatctgggagaagtcattgatgctgtcattaagcgtattcaaatgccatcttgctctgttgatgaactcatggaagtcattaaagggcctgattttccgacaggcggtattattcagggcgttgacgggataagaaaagcttacgaaaccggaaaaggaaaaatcattatccgcggaaaggctgaaattgaaacaatcagaggcggacgagaacaaattgtcattactgaaattccatttgaagtaaataaagcaaaccttgtaaaaaaaatggacgagttccgtattgataaaaaggttgaaggcatctcagaggttcgtgatgaaacggatcgaacagggctgagagtggtcattgaactgaaaaaagaagctgatgccaaaggtattttgaatttcttatacaaaaacactgatttgcagatcacatataacttcaatatggtggctatccataaccgccgtccgatgctgatgagcctgccgtctattttggatgcatatatcggacaccaaaaggaagttgtcacaaaccgttccgtttacgagcttcaaaaagcaaaagacagacatcatatcgtagaagggctcatgaaagctttgtctattttggatgaagtgattgcaacaatccgttcttctagcgataaacgtgacgctaaaaacaatttgatcgcgaaatatgaatttacggagcctcaggctgaagccatcgtgtcattgcagctatatcgtttaaccaataccgatatcacagcgcttaaggaagaggcagaagagctcggtaaaaaaattgaagagctcgaatctattctgagcaatgataaaaaactgctaaaagtgattacaaacagcttaaaagcactgaaaaagaaatatgcagatacgagacgctccgtgattgaagaaaaaattgaagaaattaaaatcaatctcgaagtcatggttgcatctgaggatgtatatgtaaccgttacgaaggatggttacctaaaacggacgagccagcgctcatttgccgcttccaacggtcaggatttcggaatgaaagatacggacaggatgctgcatcagtttgaaatgaatacgacagacgtgctgctgctctttacgaacaaaggaagctacatctattgtcctgttcaccagctgcctgatatcagatggaaggacatgggccagcatttttcaaatctgatcactattgaccgtgatgaaacgattgtaaaggccataccgataaaagaatttgatccgtcggcatatcttctattctttacgaaaaacgggatggtgaaaaagacagagctcacccattataaagcacagcgttattctaaggcgcttgtggccttaaatctgaagggtgaagatgaactgattgatgtacatgtaacaaatggggaaagccagatctttatggccactcacttagggtacggtctatggtttggagaagacgaagtgaatgtagttggcgcgcgtgcggcaggtgtcaaagggattaacttaaaagaggatgactttgttgtctccggtgagatccttcagcaatctgattcaattgtcttgttcacacagcggggagcggtaaaacgcatgagtctttctgagttcgagaagacatcccgcgcaaaacgcggtgtcgtaatgctaagggaactgaaaaagaatcctcaccgtgttgtagcactgttcgcttgcggtcttgaacagcgactaatggcagaaacagaaaaaggcgacagaaaagaactgcaggcaaaagagttgcggacaaacgacagatacagcaatggctctttcttttttgatgaagaggaatcaggtaaggttacagctgtttggcgccttcatacagaacaataataaaaaacccgctcatactatatgagcgggtttcgtttgttttttatcagctttcatggttggtgaatagatctgttacagcatgaatgacttcaatcccctgccatacaaataaattcagcgctgtgaaagaaaataagcctaaaatcaccattcttaagataaacaacatgtttaacagcctcctcatattttcgttacataatcgggtgatgttgaacatgaagtttgccgaaataagacgattgataaaatttggccagtataaagctttttttccgctgacgtctgcgggagtatcccgtacttttgctttcagcggtcagcagcagaacagccattgcccataaagcggtcagcgtaaatgcccctgtgatggatttcttctcatcatcagcattttggccggctttcatctcatgcatttcctgctggtcggctacggctttataatgatggccgatatcaaaggcgtggggaattgagaacaaatgaaaactggcaatcgccaagaataagatggatgctttcaatatcgttacttttttcaaatgatctccccctcctttaatattactgaatatttttataataataccccgatccatcctaaaagtaaacctgatttattaaatttaaaaataaatttaaccttgttaagtatatatctttttgcttatttttgaaagagaaaacttcttttattagcgtatgtatacctggtttatggtgtgaataaaaacatattttaaatgatatgtttgttgtttagggtttattactttatttatgtgctaaatcaaagggaaaggcaagagaatgggaagaaatgattacattgttaataggacactcttttttaaaagccagcttgcaaggaatgtttttattcgtaggaaaataatagagaaggggtcgacagagtaacatctggctatgacaatattcttctcgaaaaaacttcctaattcgtcatattgtgatataataaaactcgttatgttaaaaaatctaacatcaaaatcgaattcgtgttgaattgatgaaaacgggaggtaaatatggagtcttttttcaatagtttaattaatattccaagtgatttcatctggaattacctattttatattttaatagggcttggattattttttaccatacgttttggttttatccaattccgttattttattgaaatgttcagaatagtaggggagaagccggaaggaaataaaggtgtttcatctatgcaggcattctttatttcggccgcatcccgagtcggcacagggaatttgactggtgtagccttagcaattgcgacaggcggaccaggcgctgtattttggatgtgggtagtagctgcagtaggtatggcttcaagctttgttgagagtacattagcgcagctttataaggtgagagacggggaggatttccgcggaggcccggcttactacattcaaaagggtcttggagcgagatggcttggcatcgtttttgctgtcttaattaccgtctcattcggcttgatttttaacgctgttcaaacaaatacaattgctggagcattggatggcgcattccatgtgaataaaatagttgtagccatagttctggcggttttaactgcgtttatcattttcggcggtttaaaacgtgttgtcgctgtttcacagctaattgtgccggttatggcaggcatttatattcttatcgctttatttgttgtcatcacgaatattacggctttccctggcgtgatcgctacaattgttaaaaatgctttaggttttgaacaagtcgtcggcggcggaataggcggcatcatcgttatcggtgcgcagcgcggacttttttcaaacgaagcaggaatggggagcgcaccaaacgcggctgcgacggctcatgtatcccatccggcaaagcaaggctttattcaaacattaggcgtatttttcgatacatttatcatatgtacatccacagcatttattattttgctgtacagtgtaacaccaaaaggcgacggcatccaagtaacacaggctgctcttaaccatcacattggaggctgggcgccgactttcatcgcagtcgcaatgttcttgtttgcattcagttcagttgtcggcaactattattatggcgagacaaacattgaatttattaaaacaagcaaaacatggctgaacatttaccgtatcgctgttattgctatggttgtgtatggatctttatcaggcttccaaatcgtttgggatatggcggacctctttatgggtatcatggcgctgatcaacttaattgtgattgcgctgctgtcaaacgttgcttacaaagtgtataaagattacgcgaaacagcgtaagcaaggacttgatcctgtgtttaaagcgaaaaacatcccagggctgaaaaacgctgaaacatgggaagatgagaaacaagaagcataatataaatataaaacaaagctgcattcaatagttgaatgcagctttttcattattggaaataaatttaatttatcgactcgaatgaaaaatgacgtgtaaagtcccaattcagtccagttttctttgttctatatgtgtcatgtgtgtcttattcaatggagatagagtaaattgacaggcttttaaacctcccaaaaacaagaaattaggttgatagacaatcatgagaaagatttttacaatgagttcgtgctcataagaagtgaagagccaaaatgatgcgaaggaggaaaagatcagatatgaaacggtcaatctctatttttattacgtgtttattgactacgttattgacaatgggcggcatgatggcttcgccggcatcagcagcagggacaaaaacgccagtagccaagaatggccagcttagcataaaaggtacacagctcgttaaccgagacggtaaagcggtacagctgaaggggatcagttcacacggattgcaatggtatggagaatatgtcaataaagacagcttaaaatggctgagggacgattggggtatcaccgttttccgtgcagcgatgtatacgtcagatggcggttatattgacaacccgtccgtgaaaaataaagtaaaagaagcggttgaagcggcaaaagagcttgggatatatgtcatcattgactggcatatcttaaatgacggtaatccaaaccaaaataaagagaaggcaaaagaattcttcaaggaaatgtcaagtctttacggtaacacgccaaacgtcatttatgaaattgcaaacgaaccaaacggtgatgtgaactggaagcgtgatattaaaccgtatgcggaagaagtgatttccgttatccgcaaaaatgatccagacaacatcatcattgtcggaaccggtacatggagccaggatgtaaatgatgctgccgatgaccagctaaaagatgcaaacgttatgtacgcacttcatttttatgccggcacacacggccaatttttacgggataaagcaaactatgcactcagcaaaggagcacctatttttgtgacagaatggggaactagcgacgcgtctggcaatggcggtgtattcctggaccagtcgcgggaatggctgaaatatctcgacagcaagaccatcagctgggtgaactggaatctttctgataagcaggaatcatcctcagctttaaagccgggggcatctaaaacaggcggctggcggttgtcagatttatctgcttcaggaacattcgttagagaaaacattctcggcaccaaagattcgacgaaggacattcctgaaacgccagcaaaagataaacccacacaggaaaacggtatttctgtacaatacagagcaggggatgggagtatgaacagcaaccaaatccgtccgcagcttcaaataaaaaataacggcaataccacggttgatttaaaagatgtcactgcccgttactggtataaagcgaaaaacaaaggccaaaacgttgactgtgactacgcgcagattggatgcggcaatgtgacacacaagtttatgacgttgcataaaccaaagcaaggtgcggatacctatctggaacttggatttaaaaacggaacgctggcaccgggagcaagcacagggaatattcagcttcgtcttcacaatgatgactggagcaattatgcacaaagcggcgattattcctttttcaaatcaaatacgtttaaaacaacgaaaaaaatcacattatatgatcaaggaaaactgatttggggaacagaaccaaattagttaagctttttttggcggacatcagtaacgatgtccgtttttatcatctaataggaggtttgcgttgtggatgaaatactgaaacagtatatggtgctgtacaaaaaaatgagtaatatgataaatggtccggactatccaggtaaggaaaaagacatccagcatcaaaaagatcagatcgaagtttacgaaaaacagctgcagcaaggattttctacagattatgactatgatgtgtttgctgattctgttatcaaatgcgcatatggcgatatgacgctggaggatttagaagcagtttattatggattgacaacaccatttttttgatttgtcattcagcagtaaaatttcaaaatttcaatttctgtctcactaacttaagtatactttgatattgagacagaaatttatttattttaattacttcctagaatatatattatgtaaactaaaaagcggattcttttaatagttattaactcttggccttccaccttttcttcctctagctctagctgctttaagcccagacaatgttcgttcacgaataatgttccgttcaaactcggccagaaacgattacataccaaaatgctttaccaggctgcgtacttgtatctaaaacatcttgtatactaataaattcgccacaaatagacaagagcttgtatcacttagatactagctctttttgtactaaagccctccttaattgaattaaccgcgtgttcttatgtgacgttggattcaacggctaactctttgatatgcgtttatcacagcctctcggttatgtcacttgttgctggtcttcttgatcaagtccacgccatcgtatgccagactttccacacttgcagccttctgcagtaagtaatgatcaaaaaagcttttcgtgtagtctgtaacaagatttcgcatctccatagcatcccgtttgcctctgagttcctcattaacactggtaaacacgatgtcgcagtaatctaaatgcgcagcacgatcaacagagaaataataggtttccatgctattgttagcgccaattatcgcactcatgttatagttaggttcacaaaacagtagcaagaagggtttcttaaggtcgctgtcgagaaggccgaacgcaccgctatccaagcctatcccgcaggcgaaccgttcgtcgtcccggcaaactatcgccgtcgtaggccctccataagaatgtccgactatgcccatgccgatattaagccataatctgcccttaaagatggaattcagttctccagagtccagtttgaaaagataatcggctacataccttatatcttctgcctgtaattcgctatactctgttaacttggcaagtatcggcagtgtaagcacattttgacacatctcaatggccgtttcatcgtcaggccgcatctccatcttaccagccaactccaccatctccggatcttcagaaaacgccataatgacatccgaaaaatcctttgatacattaaacaggcgcccatctttacgcttatacatcgtgctattctgatggccgatgcttaccactacatatcccatgcttgccaagtctgtacagatcacagtaccccattctggagaaccgcccccgccgcaaacatagaataacaccggatagcgcttttccttcccggagagagcaaggtcgtcgtaacactgggtcttgatatcgatagagtaagcatccttcaacgctgtgagaagcggctgctcattcaacatctcgtagacttcaggaaacatgtacgttgatgtagtcttaccttcgctactgtcggacggatagtacacaaacgccgtcagttctctttttgagtgatctgatgccgtgtactcaaaatccatctgggttcgaccgacagtatagccgccaattggttcgggaaatgcgtcataagttatcactttcttcttcccccttaattaataaaagtggcgaatgaaactacatacattgcgctttaagcgcttttcaaaactgtgaaactattacatccatcttcagtgaatcatatctactccttggctatcttgagatcgtcagaaaatttatgatcttcaagcagcccatgactcaagcgttctacatttccccttccatgaatattcataatatctcagtaatagtgcaccagtcgtgttgatgccctcctacatttaaaaaccttgaatcatgcgtctttaaaacgacgtacgacacgaaaaaagcgattttctgatcggaaaatcgcttttttcagacttcgacttttttattcccgtgcagggtttagattcgtatccgctccaatgcggtaccgcttgtcttggtgtccttaacgatttacaacaaatgttgtcacgctttgagctggaagatgggccaaaaatgattgcctgatacagtgagattcgttccaggttgtagattgctgctgctgctcgtgatccatctagatacgtttgaagcagatccattctgcaaaacaaagttttggttgactcctgtgttgcttttattgatggcaacaataacgaccttgttgtcacctttataggctgacacgtaaacgttcgcattagggtttttcgttgcatcaatccttacatagccgggacgcacaaactttgagaaatgagccatattgtagccgcgtttgctgatcgtgccgtcttctttcataggaccgtatgatcttcggatgtaccaccaaacataagcttgaaaatctccctctaccatcgaactgtgaatatgatgtgaaacatccaatgcctcaggccatcgatccgccgagttgttatcactgttcggatagtatacttccgtcatccaaaggtcctttcctgctcctttttgtttgaaaagaggataagggaattgactgacctgagtgccgtacaggtgagttccgagaatatccatattgccaagagcctgcggatcgtttaaaattgggtccgacaaattcttcaagtattgaaatgactcaggcgcaatgacgcgggcattgatcgagccggcgttttctctcataaagtgaagtatttcttgcggcgtccaccacgtccactcgtgagcgtaatcaggctcgttttgtaccgaaatcgcgtaaagattcacaccattattcttcatgaaggtaacaaaatcgttaagatgctgcgcgtatgctgcgtacttgttgtatttcagccgtttagccgatgtgtcaccattacgattaaaggtctcaaccatatcacttggaggattccaaggagaagcaaaaacgattgctccatgtttgaccgcactctttgcagtctccacctctttataccaattatttcgattttcatctacatgaattcttaagattgaaaatcctaactggttctgtccattgccaaaagcagtttctctttgagctgctgtaagatccccaatccaagccgggtgattcatccctccaaaaccgcgaatcacttgtttctctgcagatacattaactgttacatcactggctgccaaaacttcagtagcgcctggccctaacatgactggcaacatagtgaaacatactaataatacacaaattgtttttttaatgcgtggaatcatttattcctctccttcgtcatgtgtcttttacggtattaaaaatctgcatggcatatcgggctgttccggtgctggcccgtacttcacccgcctcgtttttaagcggtcccattacgagtactatctttgcgtaaactgccagtaatcaaaattaagcaagtttcctgtacctgttccggtaaatacaaagaatactttgtgcacaccggttgccccgcttactggagtttctatttctctccacgtttgcgctccacctgtggaaggtacatttagggttcctacaagtttaccgtctgcactgtcgaggcgcacttctattttcccgcctatagtggatgctacatttgctttaaatgtcctggcaccgcccgctccgaagtctgcatttcctacagcaatccagtctccattttgaatgcttgttacatgctgattatttactggcccgccgggtgctgtcgatttctctgtcaaaatgcgtccattccaagcaaacgtttcagcttctacccggttatatgggtttaaattggaaagctgtgttacacctgcataatttgccgctacctcttgaatagatccatctgcattatgcaccagcttattaatatgtggagaacggtatcctttgccggcccgaacaaagcggaactgacagtttgagcatggtacactgcataccactcgtttttaaaattgaaaacagcatgatggttgtttccgccgcctccgaaaaatgcacccggatttttcaggaaatgccctctatatgtaaaggggcccatgggacttgaacttgtcatgtagccgatctcacccgggggtttatcggccggatgcgtgccgccgaaattgatgcaataggagtaataatatgttccgttatacttgtgcaatcccgaatcttcaaacatgaaaggcgcatcaattgtagatgcacttccaacaacactcgtcatatcagatcccaattttatgactctagccgttttaggattggcccattgtgcctgcgttggatttgaaccgccaggaacgcctccgccggcatacaggtaaccggttccgtcatcatctacaaatactgccggatcaaaaagccatacaacaccagacattcctggcgtacttggcgttacgagcggttttccgattgggtcggtccatggaccaatcgggctgtctgcggtgagaaccccgatacctccgccgctgtttgcgaaataaaggaagaatttatccttgccattgatttttttaactgcgattgacggtgcccatgacgcacctgcccattttgcaattccacggcctccattagctccattgacacctgctaccggaatggctccgtggtctgtccagttcaccatatccgctgaagatatgacgaatactctattcaaattggcaaatgaattatctttaattgttccgttgctattatattcatagtcatcacttgacatatagatgtagactcttccgttataggtcagcgcaaccggatccgctcccaaatgatggtcgataagcgggtttgaattccctatatgttttgcaattgtagtatttgtggcagcatacgcagacttcccagctaagcagctcaaaagtaaagcaagaacccataaacatacgctatactttttgctcatcacttcacatcctcccttttccaaaatagggtatttccttttgaaattttgatgacaacaggtcacgaagaacgcacgcataaagtagccggaagctgtttagcctggaaaattaattttgcatacatggatcgaatgttcccagttcctgttctgaaagctcatcttcatgtgtttccattctctccttccttcgaggagatcgcaccactccttcaaaattgttcaaaaaaatttccccattcctagcgaccattgtccagaaaataaaaagacaggattgttcatggcctcccactaatcacattgaacggaaattacatcattatccaagatatccctttatctaacatcctacatcattaaaaaaattgtgtatagaaacttttggaggagttagtgttcgattctacaaaggaactggatacatttattcattgataagatggggctaacactccgtttatatttgtatgtaaagatagttttcagacacaaaaaaacagccgtcaatgcggctgttttttcaagagtataagaactattgagcggtatacccgctttttcatgttttgttcatattttattaattgtttattcaacactgtccgctatagtaatccatatcaacaaatatgactgccactcgcatcttttatgaagggaggttcgttacgctgaaagaaaaaataaagacattaggccgtttttgcaccgtaggcgtcggcaatacgctgatagattttggtgtcttctttcttcttaccgcttgtcacgtctcttatctgccggcgcagatctgctcctatactgcaggtatcgtcaacagctatgtgtggaaccggaattggacgttttgtgtgaaaggtaaggctgacgggaaagagatcgtgcgttttctcatgattaatattgccgcgtcagggatcacctttttgctgctttatttgtttcaaaactgtggctgttcgctattggtgagcaagctcgccgccactatcggcggaatgatgatgaattttattggaaaccgaatctgggtatttggagattcgctgaaaaacatacaggatcaggagtgaggatgaatgagaaaaaaagtgagaaaagcggttattcccgcagcgggtttaggaacgagatttctgccggcgacaaaggcgcagcctaaagaaatgctcccaatcgtcgacaaaccggcgatccaatatattgtagaagaggccgcagagtcaggaattgaagatatattgattattacagggagaaacaaacgctcaattgaagatcattttgatcggtcggcggaattggaattcaatcttcgggaaaaaggcaagacggagacacttaaggaaatgcagcagattgccgatttggccaacattcattacatccgccagaaagaaccgctcggattaggccatgcggtgctgtgtgcggagcattttatcggagatgagccttttgccgttctcttaggtgatgatattatggtgtctgaaacaccggctcttcggcaattaatggatgtatatgacgtttatggcacagaggttgtcggtgtacagtcagttctccctgaggatgtcagcaaatatggtattataaatacatcagggtctcaagggcatgtatacgaagtgaacgatttagtggaaaagccttctcctgaagaagcaccttcggaaatcgcagtaatgggacgttatgtgctgaattcttcgatcttctccgttttgaagacaattggcagaggcgcgggcaacgaaattcagctgacagatgcgcttcgtgaggtttgccgtaaggagccgatccacgcccggctgctggaaggaaatcgatatgacattggcgataagctaggctgttttaaagcgagcaccgaaatcggcttaatgcgttccgaaatgagatctcagcttttggcctatttagaagatgtgatcaaacgggaaacgaaagaaatgctgcggtaaaaaaattgtaaccatcttgctcgtcaatcagtcatataatagtgaaaaagattaggacaggttgtgaagaatgtgggcagtttgataaacgaaattttaacatggctgacgaacatgggatatgcgggtattgcgattgggttaatgattgaaatcattccgagtgagattgtattagcttatggcggctatatggtatcggaaggcacgattggatttattggcgcaattattgcgggtgttattgggggtaccattgcccagatctttatttactggatcggtcgctatggcggcaggccatttctggacaaatacgggaagtatttattgattaaaaagcatcatatcgacatgtcggaaaactggtttcagaaatacggcgccggagttgtcttctcggctcgttttataccggttgtcagacatgccatatccattccggcaggtattgccagaatgccttttctcaaatttgtggtactgactgtgcttgctatcattccatggtctattctgtttgtttatttaggcatacagctaggaagccagtgggatgatgttgagaatatagcgggcacttatacaacaccgattatgatattggctgttgtcgtgatagccctttattttgtgattaagaaacgtacagccatatttaaacgatagctagcggatatgcataggggtgactgacgctcccctatgcatatttttttacttccgatgttgatttgccagcttcagattctccgctaaaaatgcgacaaacacttcatcccgcacgagcgatgcggcataatttctcttaataaaccattctgcctcttcaaacgctgcgaatgtttcgtcttgggtttctccgttaatttgaatattccattcgttgtctatagggaaaagaaaaaatctcatttgtgcgcgattttcatataatgatccattcgcagatccctttagattatagatgttacggaaggcatccggccgtacaggatcaatacggaaagcttcagctacaaacaactcgtatacttcatcggttattgaacagccggacgcttttgcatgccctccgccgccatatcggccggcgatttctgacacatcgatgtaatcatgaatggtgcggagactgactcgttttgaccccatgctcaaaatcgcaatgtaatcgaggtgcggattatctttccctagcctgttccccagctctgaatggtacgattcagcgtgaacgatgcctacacagtgttcgtgaacaaaggtttgtaccatttcccttttctttctgcggaggtagcgctcgattttttcgtcttctaaatcaagcagtttttcttcaaaatcatcgaagaaaaattcgtcatgcgcggaaaggcgctggatcatttttgcttcaaattcatcgattgacagcaaaaagaaaagatcattaagccgcttcgcctgtttttgatcgtaccgctcccactcccatgtatcgtattggcggacgagctctgtgaattgatctaaggcatttgtcggtttcatgaagccattttcaacgagataaccatataaaagcgatgtcgcggatgtgagccttccatcatcgtattccacctggacaaatccccattcatgctcattcaaatgaagagctgttttatgatggtcaatgagcttcactttgccccctgcatgaacatactcattcaatctctcttcgttttcttcattgacggcgagatcggtgatgaataacgcgtcctgtctgttgctctccttcgctttttctaaaaagtactgcacctgtgcgtttaagccgttgacagagttataccggacctctacgtcttttccgaacgccaattttgctacgattccgcatcctactccgtccaagtcgttatgtgaatataaatgatacataatgtaggcccctttttatgataaactgacaattgccgctagaggtgcggcagcctttatttactattctaaaaaacaaagcgttttatgcaaaggtaattagttgacataatgttgttattgtaaatatataaaggagcgctttttttgcgctcctaagttcttgcttttacactggataaaccggatgctttcgattggtaaatgtcatttcctttgtcatgtatgccttgagccgtttggccagctcatcacgcagcgaattggctgggataacagcatcaatgatcatttctgaagccagacggtagatattgatgtcctctttgtattcctcccgtttgctgctgataaatgcggctctctcttcttctggcagctcggcgatttttttagcgtagacagcgtttacagctgcctcagggcccatgacggcgatttgggcggttgggagcgctagacagcaatccggttcaaatgccggccctgccattgcatacaaccccgccccgtaagcttttcggacaatgacagagagttttggaacagttgcctctgacatcgcagaaatcattttcgctccgtgtctgataatcccagcctgttctacttttgtgccaatcataaaacccgggatatcggctaagaacagcaatgggatatgaaaagcgtcacataaggtaataaacttagccgctttgtctgctgaatcgtggaataagacgcctccttttaccttcggctggtttgcaacaatgccgacaggctgtccgtggattcgtgcgaggcccgtcaataattccggtgcaaataaggctttgatctcaaaaaatgagtcttcatctatgacccgctcaatcagctcatgcatatcaaatggtgcgttttgattttgcggaatgacgtcggcaagcggagtttcgaagtgttttggcgggcgtttctcatgaataggcgctttttcttgaaaatttgtcggaaagtaggacaaataagcccgcgccagctgtatggcttctacttcagtttctgcaagaatatctccgcagccggagattgagcaatgcatacgggcgccacccatttcttcaagagacactttttcgccaataaccatttccgccatccttggcgagcctaaatacatggaggcgttaccgtctaccataacgacgatatcacagaaggccggaatataagcgccacctgctgcagatggtccgaaaagcagacagatttgcggaatgcgtcccgataatttgacttgattgtaaaaaattcttcctgcaccgcgtctccctggaaagacattgatttggtcggtaattcgggcgcctgccgaatcgactaaataaatgagcggacagtttaatttttcggcggtttcttgaattctgatgattttttcaactgttttagctccccatgaccccgctttcactgttgaatcattcgccatgacgcaaacagtttggccgccgattttgccgatagcggtgacaactccgtcagcgggaagcccgtctgacatacattccgcaaaaaaagcgtcttctagctcaatgtcatcgtcaaagagaagggaaagccgctctctgacaaagagcttgcctttttcccgattgctttgatgatacttttccgctccgccttttcgaatccgttcagcccgttctgttcgttccttttcataatccatgagcattgcctcccttttatattcccttgtatacggcccgtcttttttcttgaaaggcctgaagcccttctctcctgtcttttgtcgggatggtttgttcatacgctttttgttcaatcgcaaggcctgtagcgagatctgtctccaatcctctattgattgcaaatttagcctgacggacagcgatcggcccgttggcagaaatggctgcggccagttcctttgcttttggcataaggtcacaaggagcggtgacatgctctacaaggccgatttcttttgcttcgtgtgcggtcacgcgtctgcctgtataaatgaattcttttgcttttcctctgccaatcagccggggcagcctttgggtccctccagcgcccgggataatagctaaccctgtttccggaagtcccagcacagctgattcagttgcgattcgaaggtcgcatgccaatgccaattctagtccgccgcctaatgcgcttccatttatcgcagctatgaccggctgcggcaaggcatcaagtaaagccgccgttctttgaatgagagatacactttccagaacctgatcttctttcagttttatccgttcctttaggtctgcccctgcacaaaacgctttttcaccggtgcctgtgaggatgacgcaacggatgtttgagttaaattcaatttcctggataatcatttgcaggtttctaagcatttccgctgaaagagcatttgctgcctgaggcctgtttaaggtgatcaacgcaatatgttcatttttaacagtaaaaagaatagaatctcccattgtatgcgtcctcccttttatcaagatgatttaaacacctgtaaatttctgctcggcagcggtttgcccattttttcttcaatccatttggccgcagatagcagtttttctagctttacatttgttttgatatccatctgttcaagcatgtacacgatatcctcagttgcggcgtttcctgatgaacctggcgcatatgggcatcccccaagcccgcctgccgagccgtcgaacaccgtgatgcccatttggagtgctgtgaccatgttggccagagcggttcctctcgtatcatgaaaatgcaaggcaatttgattagccgggaatcgtgccaaaagagcttcaagtacagtttccacttgggcgggattagccgctccaatcgtatctccaagcgaaagttcagaaatcccaaattcaaatagagcttctgaaaggcgaatgacttgttcaatggggacatctttttcgtacggacagccgaaaacagtcgagaggtaggctcttgttgtgaggtttgctttttgtgcgtcgttgtttacttgtttgagtatatgaagggattcagaagtggatttattgatgttttttctgttgtgcgtctcgctggcggacataaaaacgcaagcctcgttaatgcctccttcaagtgcattctccagtcctctttgattcgggacaagtgccgcgtacgttacccctttttctcggtcgatgccttttgctacatcgatagcatctcgaagcgccggaatccatttcgggtgaacgaaggatgtgatttcaatataagaaagccctgtcctggaaagctggttgatccaggttattttatcctctgttgagatccatacgggctcgttttgtaagccgtcacgcgggccgacttctttgattgtcacttttttaggatatgtcatggtcttcctccaaattattgagtggaatcgctcagttcgagcagtacgtctccttcatttacaaagtcgccttcattttttttgacttcttttacgattccgcttctatctgcaacgatcgggatttccattttcatcgattccaaaatggctacctcctggcccttttcgatttggtcgccggctttgacgtggactttccacaggtttcctgccatttgtatgttaaccgtcatgacaactgcctcctttataggtgttgtttcaaaaagtcagtcgtgacatccccttctttaaatgcctttgttgccgcagcctgtatgagaagcggaagatttgttttgattccctctacacgatagtcgcgaagcgctgtctctagtttttcaattgcttctgttctggtttggcctttgacaatcatcttagcgatcatcgggtcataaaaaggggtaacggtgctgtcttttgctaccgcacattcgtgtctgactcctttttggtcaggaagtgaaaacgcagtgatcgtacctggtgacgggaagaaggtcttgggatcttccgcgtatattcgaacctctatcgcatgcccgttccgttggatgtctttttgggagaatgtgagtgtatggcccgcagcaatccgcagctgctgctcaactaagtccaggcctgttatttcttcagtcacggggtgttcaacttgcagtctcgtattcatttcgaggaaataaaaattttgcttctggtcaactataaattcgatggtgcctgcgttcgtatagccgattgccttcgctgcttttaccgctgtttgcccgatcttcattcttagttcatcgtctacaaatggagacggtgcttcttcaatgactttttggtggcgcctctgaacagagcaatcacgttcaaacagatgtactgtatggccgtgttgatcggccaaaagctgaacctcgatgtgacgcgcatgttcaataactttttctatatacatcgacccgtcaccgaaaaaatctgctgcgcgttttttgtttccctcgtacgctttttttaatgcttcttcattttcaacacgctgcattccgatgccgcctccgcccgctgaagctttcagcatgacaggatagccgatttgacttgcggtgcggcaggctgcctctatatctccgagggattcagaaacgcccggcaccacagggactcctgcagcctccattgcttttcgcgcttcaattttgctgcccatctttgcgatgatatcaggggaaggcccgataaacacgatgttttcttgcttgcagcgttcagcgaatcggctgttttctgataacaatccatatccagggtggatcgcgtcggcatttgcttttttcgccgtttttatgattctctctatatttaaataactttcactgactctcgattccccgatcaaataagcctctgtagcggcttttgtatggggcgcgtccttgtctgcttctgaataaaccgcgaccgttttaatgccgagacggctgcatgttcggataattctcattgcaatttcaccgcggttggcgatcagtacttttgtaaacatgatttcacctcattgacttgatgataagttgaacatttcaatcgttttttctcgcagtttatatttttgaattttgcctgaggccgtcatcggatagtcatccgtaaaaataacataacgcggaattttgtggcgggcgattttccctttgcaataggctttaagctcatcaggtgaaacgcttttaccgtctttcagtttaatccaggcagcagcttcctccccgaatttggcgtcaggcacaccaacgacctgtacatctaaaacagcgggatgccggtataaaaattcttcaatttcccgcggataaatgttctcgccgcctctgatgagcatatcttttaatcttccggtgatgcggcagtacccgtcttcatccatgacagcaagatctccggtaaacagccattcgtcgtgattgattgcttttctggtcgcttctttgtctttataatagcctttcatgacgtgatagccgcgggtgcacagttctccctgcatgcctctttgaacttcttgacatgtcccgggttctacaattttcacttcagtatgtggcagggcgcggccggttgtttcgactcttcttatgaaggaatcatttgctctcgtttgcgtaatgactggcgaggcttcggtttgtccataggcgatcgtaatgtctttcatgcccatcctttcaatcacagctttcatcacttcacttggacaaggagagccggccatgattcctgttcggagcgtcgatagatcatatgcatcaaaatccggatgatgcagctcggcgataaacatggtaggcacaccatggagcgccgtgcatttctctttttctaccgttttaaggacggtaacgggatcaaattcttgcacgggtatcatggctgccccgacggatacacatgctaaaaccccaagcacgcatccaaagcagtgaaaaaacggaaccgggatgcacatgcggtcttgagaggttaaaaccatacattcagcgatattagcagcgttattgatgacattgaaatgggtcagcatcacgccttttggaaaccctgtcgttcctgatgtgtattgcatattaatcacatcgtctttatccaggctgttcattctctcttcaagctcagcatctgtcactgttttcgccaatatctctgtatcgtcccaatgatacatgccaggcaaccgtttattgccaatatagatcagcgtttttaaaaagggatagcgttctgatttcagttggccgggcattgcttcttgcagttctggtattaaactgttcacgatgtctggataagaagtgcctctgtatgaatccatgatgataagtgccgcggcatccgattgctttaacaagtaatcaagctcgtgtgcttgataattggtattgacggttacgagcacggctccgatctttgcagttgcgaactggacggcaagccattcagggatattagaagcccatatggcgacgtgatctccttttccaatccccatccgcatgagacctttagcggtttgacggcaaagattgtcaaattgggcgtacgtatagcggatatttaggtctggataaacaaccgcttctcgatcgggatgcgcttcagctgtttgttccagcagcctgccgattgtggaatggatgagttcagccattgcttgttcctcctttcttaatgatgggaaagcgtttacatttttattttaaaagctgtctggcgatcacgagacgctgaatttcagatgtgccttcaccgatttccattaattttgcgtcccgcagcatccgttccaccccatactctttcatatagcctgaacctccatggatttgaatggcttgattgcaagctcttgtcgccatttcagatgcgaataacttggcgtacgccgcttctttggtgaacgggcggttatggtctttcagccaggcggcttttaacaccatttgccgtgccagatcaatttccatcgccatgtcagcaagcttaaattgaatcgcttgaaaggaagaaatcggctgtccaaactgctttcgttctttcgcatatgccaatgatgcgtcaagggccgcttgagcaatgccgactgcaagagcagcgatggagattcgaccaccgtccagcgtatatagaaactgtttaaacccttttgttggatcgccgagtaagttggccgcaggcactcttacatcctcaagcaaaatttccgctgtattcgaaccgcggacgcccattttatcgtacgggctcgtaatcgtaagtcctggtgtgtcagttggcacgattaatgcggagatgatgttttttccatctttgtttttgcctgttactgcagtcacaataactgtgcgtgcgtagcttgcattagtgatccagcacttttcgccgttgattacatattcgtcaccatttgaaatcgcttttgtttgagtgcctcctgcatctgagccggcatttggctccgtcaggccgaatgatccgagtgctgtgcctgaagccagcggcgtcaaatgcgtccgtttttgctcttctgttccgaagtagtatagagggcttgcgcctagcgagaccgctgcagcatagcttaatccagtactgccgcaggctttgccgacttcttcaaccgctaaagcatatgaaatcgtatcaccgccagatccgccgtattcttctggaaatggaatacccatcagaccgagttcacccatttttttaaatgtttgcatcgggaactcgcctgtttgatctacatgttcagcgtgaggagcaatttcttttttcgcaaaatcttttaccatttcacgcaccatttgttgttcttttgtcagctcaaaattcacatcgtttcctccttcacatctttgtaacatcctattaggcgagttctataatcattccctgacaagaaaagtctgaaaattaaaactgaatcattttttatgtgataatttcagcggaatgagcaaatacatgcagtaggcgcataccatccatatcgcaaacgcaataacttggccctttgataaagccgggaatatgaggggatgattccaaagggaaatcgtatccatcaataaaccgaccgctgatccccatatacctagcttgatcaccgcgaactgtgattgatcgagtttttgatagagaaagaacacaaagcataaaacaagagcggtgcccgctcccaagagaagaaagttcggcaaaaaggcttcttcagccggatcagtcaaacagcatctccgaacagcacaaaaaataatgtggcacctaaccagactagaaatgaaaacgtaaggacaagtctcaattgatgagtaaacatgttcgatctcctttcgtgttacatcatgttttcagtcagcttcaccagcatccattcaagctcctggtagacatcttccgttgtaaaatcatcagtgacgagagactggatggcaagcccgtcaattaaagcattcagcatgattccccatgttgttaaggaaacgccgtcaattggagatgtgccccacaatcgagtgagctcttctgtcagatattgattttcggattgtaacagatgacttagctgctctttgatccgttcattttgaaatcctgtaacggtcagcttctaaattagttagttcaataactataactcttgtaattacaataatatggaatggtcaagaatgccgtagattactaaatcgacaacgcccttgccagaccaatattgcccgatgacgccaatcattttatgtactgtctttatgttatgttttgggatgatccggcagtaatcgaatactttgcgattatcatatatcgaagagaaacacgtcctgtacgtgtttctcttcgattttacttagtactagtttctcagattccaataatggaaaatgtccaaacaccgcctacagcggcttactatcgtttcctgtctccaaaatcacttttaaaaaaagacgacttagaaagccgtccttctcatttcttattttgttgttcgtttggaagccttgctttcgttatgaagccggtctgctgaagtgacataatacgtatatttcttgttgggatctgccgtgttatctaagaaggtttgctgctcatgtgtttttctttgcgttgccagcaatgttctctgctttttcccttcggctctgtatatcgcataataggctgtttctttcgttttttgatttgatgggtgatctttaatctgcagaagattgccgtttttgtcttcggtgactttcgtaagcttcggtttttttggggcggtattgtcaagccaaggcatttgcggaaccagtgccggcttgctgtaaagatcggtgctgagcctgtctttgatgccaagcggatttttgttgaggtccttgaggctgaaatgcatgcttcctttcaccagttcaagctggtagttcaaagtgatttgccgcacatattcctcaggatcggaccaaggcggatcaaaattgttattgattttatatgctgcctggccaatatataagtgaacaggcctatttttgacttcattgctccaccaatcagccagcacgtcgtaagccgctgcgttaaagccgatactccaataaatttgcggagcaatataatcgatgtcgccttcttggatccaatgccttgtgtctgcatatagatcgtcataatttctgacgcctgcttttgtattcgatccggtcgggtcatctgcggcgtttctccatactccaaagggactgatgccgaatttgacatacggttttgcagctttaattgtttggttgatttgtttgacaagctggttcacattgtcccgccgccagtcatcgatattagaaaaagcgtcttttccgtattgttcatactgtgcttgatcaggaaattcctgtcccgctattttataagggtaaaaataatcatccatatgaacagcatcgatatcataatgttttacgacttcttcaatgcctttgacgataaaatctctcgcttctggaatgcctggatgataatacagctggtttccgtaggcggcaacccaatctggatgttttcttgccgggtgatcctcagacaatttattaagatctgtatgattcattgtaatacggtaaggattaaaccacgcgtgaaattccaaatttcgtttatgggtttcttcaattataaatgcaagaggatcatagcccgggtccttcccttggacaccggttaagtattctgaccaaggcccgtaagctgacggataaaaggcatcagccgtcggtttaatctgaacgataacggcattcattcccattttttgcacatcgttcagcagtttgatatactcctgtttttgctctttcacagataacccttttttggacggccaatcaatatttaatacggaagcaatccatacggctctcagctccctgtcagactgcgcattggccataaacggaacggaaatgacaaacgttccgatgatcaagctgacaaggaaacggacaatcgacttttggcaaaccttcattctgtttcttctcccccattacatcactttcactattcgctattacggtattcccgggctttaaaagggtgattaacagaatgtctatctcactaaataaacgaaaaaagtcctaaagcatgttgtgaaccgcttttaggactttttatcattcatcatggtttgcagactttttaacacatcaataagttttacgccgacaccgacagccgtttcaaggatcgcttgtgctccggcaatggctaaaataaagatcagcggtattgcaatacgaggcaaaaaaagatagccaagtccgatcaagatggcacaccaaacaccggcacaccagtagcaattgagcatgtatccaaagttagaagccggcacgcttttttcatctacatgcccgttttgatcaacaatccttttctttttcataaaaggttttcggataaattctgtgattttgtcgaatacaatcaaatgtgtcagcctgtaactggctagaatcagcatgataaacgtaagaaaagataaatgatccatgacaagcctccaagaaaaaggatgatgttatcattccctagtgtcatcgatccattctttgatacaaaaagaagcggacagagaatgcctctgtccgcgaatccgctctattgtttgtgcgggattgctttatttgaagtgatcttttctaaaatgtctaggatgatgtcagcattcttttcagcatatgttccttccagcatgtctttatgagcgccaaaacccgtgtactcactatagtttccacaggtgccttcccatttcgttaagcttgtatgcccgctggtttcggggtggattccagcttcgatgaaatgaatgcttgctttgatgtgcccttcattcagcaattgtgcccaatatgcctgatagtttctttttttcttcatcaccttttctctgactgcttcaggcagatatgctgcagattcgtcatttccggtatcgataggcaaaggctgttcttttagataagcgtccacgataatgaaatcgctgacttccaatcctttgcgctccatagcctgtgccacttcaaaagccaggtttccgcctgcagagtagcctaataaaacgtatgggccctcaggctgtatgtccgtcatgcaattaacatattgttcaatgcgggtgtcttgttcaataaagtgaaacccgtatacggctgccttctcattcagcaataaagcaagatctttaaaataaatgccaaatccagatatcggcgggaagcagaaaagattttgcgcgccgtgctggttcagtttgatcacatgctgttcatctgtcgctctcagctgtttagaataaagtttttcggcaagctgagcgattgtcggatgttcgaacaagaaatcaatcggtatgtcaatgttctgctgatgttttagtgtatgtatgacttgcagtgcttttagtgaatgtccgccaatagcaaagaagtcatcatcaatactgattgtgttaacaccgaggacttgcttccaaatgttcgccaattcttcttcaaccaagtttcttggcaatatgatgtcctgtcgtttggcagacttattttctggaataggcagcgcgctgcggtctatttttccgtttccggtaagcggcatccgctccacacgcacccagtgctgcgggatcatatagtctggaagcacacgcgccaaatcggcgcgaaaatccgtatctgtttttttgtgatcgccgacgtaatgagtgtacagctgcgcctctccatctttttctctcaatgtcactgctgcttcttgaacgccttccatttctaacaggcgcgcttctatttcggcaggctcaattcgttttccgcggattttcatttgcctgtcaattctgctgatgtattctaagtttccatcaggcagccagcgcgccaaatcaccggtacggtatattctttcaccaggcaagaaaggatgaggagaaaaaacagcatttgtcaggtcatctctgttcaaatagcctttagcgacaccatcaccgccaacacaaagctcgccgggaacgcctattggcaaaagacgtccttttgtatctaagatgtaagcggtgctattgctgattggttttccaatcggaatcggccccgcatagtctctcttcatttcaaaaaaggttgaaaaagtcgtgttttccgtaggcccgtaaatattatgaagcgcgagatctggacaggcgtgcctgacggcattcatcagggcaggagagagtgcttctcctccgacatataacgtatggagtccgcgaaacatgtcagctcgtacctgtgccagctgattaaaaagagccgtcgttaaaaatagcactgtgatgtcattttcaagcaaatacgctccaaaccgatcaggtgacagcattgtcgatttatcaatgatatgaaggcttgcgccatttaaaagtgccccgaacatttcaaaggtgacggcgtcaaagctgatagatccagtaagaataaaccggtcatcaccggacgcagacgtgtaattgctgttgctgacaagggacacgacattgcgattcgtgatcatgacccctttcggccggcctgttgatcctgaggtatacatgatatatgcaagatcatctggactggagctgctgttgataggaaaatgattctcttccatcaatgcctgcgcatctgcaatcatacatgttcctgagaacgcagcattttgctccaatcccttttgaacaatcagcatttttgcttgcgtttcctcaagcataaagctgactcgttcaggcggaagctccgcatcaagcgggaggtatgctccccctgcttttaatacggcaagcacactgatcatgaattcgggagaatgtgcagccaatattccggctgtctcgtttatccgaaatcccttttgaattaactctctggcgagcgcattagagtgtttatcaagctctttatacgaaatagacatattgccatacacaagtgcggtatggtctggcgtcttttctgcttgttcgcgaaataaatccataattgtatgattctttggatactccgtttttgtattgttgaactgtgtgacaatctgctctttttctgttgcatcaagaaaagaaaaatcagcaattggcatatgagggtgctgtgccgctgtgctaagcgcttgcgtaaattgcctcttgatacagctgatccaggcagcatcgtaaacaaacgcattatagctgaacttgatgacaagctcttcaccgggagcaacgacaagattaaaattatatcctgattgctcggatacttgaacttgatcgatttgcagcggtgaatcggtttgatcagcggaatcggcgattttctgctgtaacggatagttttcaaagacgataatgtgatcaatcagttcctgttttaatgcggtgtttgcctgaatatcaaataaaggttggcagataaacggctcagcttccagcatttctttctggcagcgtatgagcagctcgtgaaacgtttcgtcttgatgtgttttaattcgaatcggtatggtattgataaacaaccctatcatttgctccacgcccgggatttctgacggtcttcctgatacaactgcgccaaacacaacgtcgtctgtgcggttatattgctgcagcatcacaccccagaccgtctgaataagggtagcgagcgtgacgccatgttgtttggcagtctctttgagcttgtctgtcagtggtttatttaatgaaaatatcaaatcttcacggtgataaccttcttttgtttctttatcagacacacgaggcagaggtgatggagtgctgtagttttttaaataggtatcccagtaggccgctgctttttctttgtctcggtttgtcagccaggaaatataggtgctgtacggacggacagggtctaatgaaagcggctttcctgcatgaatcgattgataaatttgcataaattcctgcataacaatacctaggcaccatccgtccattaaaatatgatggtgactccagatacagacatgctcatctttagctgttttgaatagagaaatccgcatcagcatgtctttttgcagatcaaagcctttttgcttgtccttctccttaaagcgttcaatatactcattctggtcgtttgttggcagatgagaaatgtcttcgctgtacaaatggaattcacgttctgtcatcacgacttgccgaggtcccgacaaatgcgggacgtgcggcaaaaacacagttctgaaaatatcatggcggtcgataatggcttgaatgctgcgctgaaaccattcatagctgaggcttcctttaatggtgaagagcgactgctcaacgtaagccccctcctctttacggaggaaggaatgaaacagcatcccctcctgcatgtgactcagaggataaatgttcttgatttttttaatgttatccatagtgtctgcacctttcttcacggattcattagtgaaaactgagcatatcagcgatctcttgcagcgcgtcctcggtcagttcttgatcatcataatcactgatcgtcttttctgtttcgcttttgttctggcagtgttcgatcagttgtaataaaaattgacggcatgtttcgctaagctgttcgatggttttgcgctgaaagcgggcattgtcataagtcatattgacagtcaattttccttctgcagcgattgcgctgatatccagcgactgttcacggttccatgttgtgctgatatcacctccggcacccagcggagagaatgagaaggtgtcctcctcaggtacttcagctgtgcggccgctttcaaattgaccaagataattaaagctgatttctggtgcacctgtgaaatcgatgtcttttttgccaggcggagtcaaatatttgatgacaccgtagccgaatcctttgtcaggtacacgtctcagtgtatcttttgttgtttttagcacatgaaccatgccttcttccgaatctggcaagtctgcgttcagtttaatcaataacggataaatggcggtaaaccatccaatcgtccggctcacatctattccttctaatacatcctctcgcccgtggccctctaatgatagtttgaaggcggattgattggtccaatggcgcagcgcaagaatgacagaagcgagcagcatgtcctgcgtatcagtgttgtatgcgttgttggcgtcttttaagagtgctgctgtctctttatcgtttaaggtaaacgaaattgtggaccgttgtccctcgtgtgctctagttccatcgatttgatcaaaaggcaatgcctttgtttgatactcttcggcttcgcgccaatacttgagctgtttcattagctgctggctttcagcgtagtcagagagctttttcgcatacgctttaaacgagcttgttttaggcggcagtttgatatcctccccgccagcagcttggcgataccctaaagccaaatcttcaagcagaacccgccatgagatgccgtcaacgacgaggtgatgagcagataaaaataagaaatcaccgtcaattgtgtggaaaagaccggcttgcagcagcggaccattcttcaaatccattttctgctgaatatcaagtacatggcgtttgataataggctcatacgctctatttccatcagtgcataaatcaatcatctgaaggccgtacaacgcgtcgtccgaatgactgagcggccgattatattgagcccactttccttgttcattctgtgtaaacaccattcgcagcgcatcatgatgacacgttattgcttttaacgtttttcgcagtgcgtcttcttgtacagaggtgcttcgatgcagcattacggactgattaaaatggtgtttttcttttatatcttgagaaagaaaccatttttgaacaggcgaccattgtacgtctccctcaaccgcagcttggctggaacttgtatctgaatctcggatataagctgccaattcttgaatggtcggatggctaaacaaatctttcactgccatttgcttgcctatccggtgaagccgcgcagatacctgtaacgctttgatcgaatctcctccaagctcaaagaacgaatcagctgttccgattttttctgcacccagtacatccttccatatatccgccagtatttgttccattttgctggctggcgggaggaatggacgttcaccttcgcgattgtgtacaggtcttggaagtgctccgcgatccagcttgccgtttggtgacaatggaagtgagtccagtttttcaataaacgcagggtgcataaacaccggcagcttgttttgtaattctgaacgtacagcatttgtgctcaactctggttttgtcaccacataagcacttaattcggtttgtcctgacgctgttacatgagcaactactgcggcgtcttttacaccatttatacatcggatgaccgattcaatttctttcgtttctacacggtatcctctgattttgacttgatcatcgattcttccgagatattcgagtgtaccgtcggccatccatctggcggcgtctcctgttcgatacattcgtgcttcgggtttaaatggattctgcgtgaatgctctctctgtcagttctggaagattgacgtaccctcttgcaagccctgttcctgctatacaaagctctcccgcaacaccgattggctgaagctgatgattgctatttaaaatcagcacttgagtcccgtcaatcggctggccgatgcttacgtatgcctgcttttccatatgtctcatgacggtagtcgccacgctgttttctgtcggtccatattcgttggcgagttcggtatgcggacatatagctaagctgaggtcgatcaattcgcggtcagccgcttctcccgccagtgtgacgactctaagcgtctttacatcttccggctgcactacgtccaaaagcgctcgatataaaacaggcacaataatcatatgtgtaatccgttgacgagacagctgatgcttaatggtcagaatatccttcgcttcctcttcatgaagcaaaacggcttttgcacctgacaaaagcggtgtaaacatactagttataaagccgtcaaatgagaaagaaaagagctgcagaatggtatctgtctcgttgaatgcataagcgtttctccgccactgaagagtgttggcaatacctttatgctcgaccattaccccttttggacggcccgtcgttccagaagtataaatgatataagccaaatgatgggcagacgacatttgcggcagcggcgatttgtcgtcttcctctacgctttctatcgtcaagatctctccttcaaagtcagcaattactccccgatccgcttcatttattgtcatcagcagtttcgttccgctgtcgctgaggatatagcgtttccgttctgtcgggtattcaggatcaatgggaacgtaacagcctccggctttccacacaccaagtatggatgctatcatactgaacgaacgatgcatcatgatgcctactggtgtgtccggcttaacacctcggctgcgcaatgcacgtgcgattccattggaccactcgtccaactcttgatacgtcagtgttttgtcttcgctgacaagtgcagaagcttttggtgttcgtgcagcttgctgctcaaacaattgactgattgtttgaactccgtattgattcgcttgcccggtgttaaactcattaagcagctggtgccgctcttcttgggtcaggatgtcgatctggttaagtgtcacctccgggtttttaccgatgatgctaagtacatttgttaaatgcgatgcccagcgttcaatggtggttttctcgaacaatgcggttgaatattcaaaaaggaaatgaatgtttccgtcgccctcagatgcctgtagtgtcaaatcgaatttagaaacgagatgagaaacttgtgccggcttcatttgcaaatcatgaagatgcaatggctcgtaatcattattttgaacaactaacatcgcatcaaacactggatttcggctcatatcccgtgtcaattcaagcttatcgacaagttcttcgaacgggtaatcctgatgctcaaaggcttccaatgctgtctcacgcacttcctgcaaatactgtacgaatggcttcccgccctccgggcgcgtccgaagcgccagcgtgttcacaaacatgccgagtatcggctcaagatccttgtgcggccggccggcaattggcgagccgacgatgatatcttcctgtccgcttaagcgtgacaagaacgcggtgtaagccgcaaggagcaccatgtacagtgtgcttccgttttctcgtgccagcttgtgaaggcctgatgcaacctctggttccagcgtaaatgagaccttgtcacccgcgaagcttcgcaccggtgggcgggcatgatcagccggaagatccagcacaggcagctcgccctcgagctgcttcagccagtacgtctcctgcgttttgtacgcgtctcctgttttgaattcttcttgccatacggcgtagtctttatattgaatgcgcagcgcaggaagattccgattattgtacagctcgccgaattcccgaatcagaatgttgacggaaacaccgtctgaaatgatgtgatgcatatcaaccagcaacaggtgccgctcatctgatacctttacgatttgggcacggaacagcggcgcttggctgagatcaaacggtttgataaatgcggctgtggcctcctgttcggttcgtgcgccgagaactgtagtctgtagcgtaaacggcgcctcgtcatggatgcgctgcaccggatcgcctcctgcgtcctgttcgaaggaggtccgaagcgactcatggcgcttgatcagctctttgaaagctctgtccatcctttcagggttgagcttcccttcgagctctaacacagccggcatattgtagcctgtccctccgtcctccagctgctgaaggacataaatccgcttttgggcagaggaaaccggataggtttcctgtttttcagcgggcttaatcgcttcatatggactgtccgttccttcacggataacggtagccagcccttctactgtcggatgggcaaacacctcttttagcggcacctgtacatcgaattcttttgagatccgtgagacaagcgccgttgcttttaaggaatgtcccccgcggtcaaaaaagttgtcgtgaatcccgacagggccatttttcagcacgtcctcccacagctgagaaagcttcatctcagtcacgtttctcggcgctgtgtaggtctccgcatctgccgctccgccaggagctggcagggcgtttcggtcgagctttccgcttggcgtaaccggccactgttccatctctatcatataggctgggaccatgtagcccggcaacagtctctcaagctgcgctcggatttcgtttctttggagcccttctacataagcgcataattccggctcgccgctgtctgtccgtacggtaacggccgcctcccttacgccttttatgcttcttagtgccgcttcaatttctcccggttcaatccggtagccgcggattttcacctgatcatccgtacgcccgagaaattcaacattcccgtcagggagccagcgcgccacatcgccggttttgtacatgcgttcccccgggtaaaacgggtcttcaagaaaacactcctccgttaatgccggccgattcaaataacctctggcaacacccgctccggcaatgtatagttcgccgatacatccaacaggcagcatccgctgattctgattcaggatatataatctgacatgatgaacaggttttccaattggaatccgttcaagtttttcatgtggcggacaatcaaagaatgcagcttctacggttgcttccgttggcccataggaattggttattgaaacatttggaagcaactcgtaaaatcgggagacaagatgggtccccagctgttctcccccagaaaacactcgcttgagtctgtttgtcttaatcggtacagagcgatattttatatgttctaaaaatgcatggagcattgaaggcacaaaatgcatagctgtgatcttttgttcttctatggccttcacgatcacttcaggttctttttcgcctccctgaggaagcagataaacagaagctccggcataaggccaccaaaacagctcccatattgaagcatcgaatgaataggatgttttgtgcataatcatgtctgaatgctttagctgatagcgggactgtagggaattcaaaaaattcaccgctgatcgatgttcaatttcaacacccttaggcatcccggtagagccggatgtatagatgacataggctaaagattgcgggagaacgttcacattcggattggacaaacgatgtgccagtccgctatttgtctgattgagatagacaatctctcctgtaaatgccggaatatgaaggctggcagactgaagcaggagaatgtttgtaccgctgtcctccagcagaaagctgattcgttcttccggataatccgggtcgatgggcagataagcgccgccagctttaagaatgccataaatgccaagcagcatttcaggtgaacgctttcctataatggcaacagtcgtttcgggttttaccccccgtccaattagctcccaggcgatacggttagcccgttcgttcaattctttataggtcatcactccatcttcgaagataacggccgcctgatcaggcgtttttgctgcctgctgttcgagtgcatagtggagcgtttgattcattgaatagcccgtctcctcatacggatggcatgattcaatgaaatctctctcttcttcttttgttaagattggaatatcgtccaattctgtttcagggctggcagctgtatgttccacaagcgtggtgaaaaggctggcccacctttggatggtttctttctcaaacaaagctgtactgtattcaaactgacagaaaagctcggaatcatgctctgtaacgtatagggaaatatcaaattttgatattgggtgctccaagtcgttccactgaagctgtacatcattcatttttagcttttgctgttccatattctgaaggactagcgttgtgtcaaacaaaggattccggctcatttcccgctgcacaccgagtttgtccacaagctcttcaaacgggtaatcctgatgctcatacgcttctagtgccgtctgtctgacttcttttagaaattcctcaaatgtcttattacccgccgggcgtgtgcggagagccaatgtattgacgaacatcccaagaacagcttcaaggtcggcatggggccgcccggcgataggtgaaccaatcacgatatcatcctgaccgcttaaccgagacaaaaaggctgaatacaaagcgagaagcgtcatataaagcgtgcttctgtttttatgggcgagccgctttatgcgggccgtgatctctttgtccaattgaaaggttacttttccgcctatgaattgccgttctgccggacgtcgtttatctgttggaagctccagtataggaaggtccccgctaaactgctgctgccagtaagtctcctgcttttggtacgagtctccctttttaaatttctgttgccatacggcgtaatctttatattggatccgcaatggcttaagctgccggtttgcataaagatcggtaaattctcggattaggagctgaacggatacgccatctgaaatgatatggtgcatatccaccagcaatacatgcttctcgtttgacacttctataaggcctgctctaaataatggcgcctggctgagatcaaagggacggacaaatccctcgatagtggtctctttacttaacgtaaacggcacttcggtgtggatacgctgaaccggctcgtcatcagctccggatacaaaggaagttcgaagcggctcatgccgattgatcagttctttacatacagcagacagtttggcgacatccagtgcaccttccagttctaagaccgcaggcatgttataggcgacaccctcatcaagctgttgaagcacatacattcgtttttgggccgaagatacaggatatgtacccctttcttctgctggttcaattgctgcatacggattttgttctgcctctcgaatgattgaagctaatccttcaacagtcggatgagcaaagatgtccttaagcgaaacttgcacatggaattcctttgcgatccgtgacataagcactgttgcttttaacgagtggccgccatggtcaaaaaagttgtcttggatgcctatatggccattattcagtacatcttcaaatagttgtgaaagctttgcctctaacagatttcgaggggcagtatatgggtttccgctgattgaagcatctggccccggaagtgctgcgcgatctacttttccatttggggtaagaggtatgctgtcaacccatatccatttcgccggaatcatgtattctgggagctcactagccatataactgcgtaaatctattgcgttcagcttttgtacactgcaatagtaagcgcataattcatgttcaccgttttgatcttgccagatgagaatggcagcctcactaatgtccgggtgattcattaacgtgacttcgatttcttgcggctcaattcgataacctctgattttcacttgattgtctgcccgtccgatatattcgatgttgccgtcttcaagccgtctggccaaatcacctgtccggtacatgatcacaccaggcttgaatggatcggatgaaaatttgtcgcttgtcagtttatcgtgattgacatatcctctggcaacacttgcgccggaaatatagagttcgcctggtacgccgcatggctgaagctgtttttgatgattcaaaatatatagatcagtacagcctatcggtttaccgattggcggaagctcaggaatagggtctccaggatgaatggtatacgtagataccacatgagtttctgaaggtccgtaatgattgtgcaggtgtatgccgcgttcacgcaacacatcttggaaaaggtctgaaatcattaattgttccccggctgcgatcaggtgtttgacgccatcaggaaacgagttcgcaagttctcgctcgctgaaaatcattttgataaaagcagttgggagaaacacaatattcgtctgatgcttgtttataaatgcaaacagctgaggcacatctctttttatggcttctggcacgatgtggagtgtgccgcctttcagaagcgcagaaaatatttcttgatagcagacgtcgaaggaaggtgtagcaaattgcagaacatctgcttcaaagtcaatgccggagtgagtatattcgaacttcagcaagttagccatgtttcgatgctcaaattgaacaccctttggtttacctgttgtgcctgatgtataaatcatatacagcagatcgtcagcattgttgactgactttatgttactgccgtctactttgctttcgatatcttctggatgagtgataatgtaattgtcttctaacgatgaggaaaggtgcgcttgtgaaacaacatgcgaacagccgcaatcatgcagaatataacggattctgtcagccgggtaatgcggatcaaccggaacaatggcgccgcctgcctttaagattccaagaacgccggtgataaacgccgcagagcgttccatcataatcgcaacgggttcctgtctcacaacgcctttcattcgtaaatgccgtgccaatctgttagccgctttattcagttctctgtatgttaatgagcaggcttgatcaattacagcatgagcatctggtgtcttttccgcttgcttttcaaacatggcatggatggtttcgtaaactggtgttcgatctgtgatttctccaatcagctgccgcttttcagtatctgtcgtgatatcgatttcttcaggtggaagattcggattatttaagatttgcgatacagcattcagaagatgctctttgacagagagcacaaaagaccgatcgtgctgctccgcatcatagttcattttgatatgaatttcttcccctggcgccaccataagataaaagctgtagttggtttcatctgcgacagtgaaattatgaatctgaaaaagatcagaagcatgttcctgtttgttcagcatttgaatctcttgctgcaccggatagttttcaaatacgagaatatgatcaatcagcccttgtttaacagctgagcgggattgaatctcatataaaggatggtagctgtacgcttcagcggcaagacggtctttttgcatatcttttataagttgaagaaaaggcgtttttgccccctgcacccgaaccggcatcgtattaatgaaaagacctaccatatgttcaatgccttcgatttctgcgggtcttcctgaaatgacagaaccgaatacggcgtcatcgttattattatatttttgcagcagaatgccccaaatggtatgaaaaatcgtactgagtgtcacttcttctctagcagcaagctctgaaagcctgctgctttcttccttagagaatgaaaatgtaacgtgttcctgcctgctttttccctttgtttttttctgcttcgggagcacggtttgctgttcgtggccggaaagataatggtcccaataagaaaccgcctgctctttgtcttgctccatcagccatttgatatactttccgtatggctggaccggctccaatgttattggggatgcatttacataagatgcgtaaatatgcagaaactcctttagcacaatgctgaggcaccaaccgtccatcatgatatgatgaaaggtccaaatgcaagtgtactggctctctcctgtttgaataagagcgatgcgcatgagcacatccttttgcaaatgaaacccccggtcccggtctttttctttccattgctcgataaactgtgattgctccgcctcgtttagatgagtaatgttttcttccagtacgatgacatttcgttgtctcagaacaacctgctgaggagaggaaacattttggctgataaaaatcgttctgaaaatatcatgtctttctacaagagcgttgatgctgttttgaaaaaactgcgggttgacttttccttctattgtaaaagaagcttgctcaacatacgcctgtgaatctttttgcaggagggaatggaaaagcatcccttcctgcatgtaagacagcggataaatatcctgaattgaattcgcttttgtcatgttcatgtctccctgtcacgattttctacaattcttccaccaagctggatatgctgtccaagtcctctgccgttaatgattgactgctgaaatcgctcagtgtcttttctgctttctgttgaccggcgcagtgtttcataatgtccagcaaaaagtgttcaatcctgttaataagctgctccattgtgtttctgtgaaagcgggctggcggataactaagattgaaatggagctttttgtctgctgccattgcgctcatctcgataatttgctcgcgcttccatgtatgagtgatatcctttccgctaccaaggcttgatgggcggaaggtgtcctgtctttcgatgtcgttgaactggcccaaatagttaaagctgatttcaggtgtttttgaaaacgtaatgcttttattttcagggtgtgtaaggtatttcagcataccgtaacctacccctttgtttggtatccggcccagtgtatctttaacggtttttactgcggttccgagctcatccctatgattttcaaagcttatgagggccggatacatggatgtaaaccagccgaccgtcctgctgatatctaactctggcagaatgtgttctctcccgtgtccttccatagcgatacggagcttacttcctcctgtccattcacaaatcgccaaggatgctgcggttaacagaatatcttgtgtatctgtgccataggcgtaattgacgttttgcagcaagacggcggtgtctgcttcagtcagtgaaaagcttaatgagtcccttttgctggagtcgatgttcagatgatgcggtatttcatatggcagttctgcggcttgctgttcttctacacttcgccaatacgcctcttcgcgaatcagcttactgctttgggcatattcctgtatgcgtcttgcgtattcctgataggaatcagttttaggcggaagctggatcgtctggccagcagcagcttgttgatatcctgctgacaaatcctccagcaaaatccgccatgagacaccatcaacgataaggtgatggatcgcaaggaacaagtaatctccggtcagtgttttaaacaaagcggcgtgcaacaatggtccttcctgcaaattgatgctttgctgaagatctgcaacttcttgtttgatttgcgtctcccagccgctttctgactgtgaaagatcagaggttcttaagctgtatagctgtgactcatgaatgccttggttgatttgaatccatcgcctgccatcgttgcgataaaccatccgaagcgcatcatgatgctccgccagttttttcaaggctggtctaagggcgttttcagacaaacgtccagaatggaatagcatgacagactgattgaaatggtgtctttcttcaatatcttgtgaaaaaaaccattgctgaacaggcgtccaaggaacgtctccctgaacgggtccttgctctatgattctctctgacttacggataaatggtgataagtcctttatctttggatgacggaataaatcacttacctgcaagcttagcccatagcgcccaaggcgtgcagaaacttgaagcgctttgattgaatctccgcccaattcaaaaaacgaatcctctattccgatcctctggatgccgagaacctcctgccagatcaacacaagttggtcttcaaggtcatttcgaggcggagcgtacgtttgtttagatgtgaaatttggttcaggaagtgcttttcggttcaatttgccgtttgatgtgagcggaagagtctccatttcaataatgtacgccgggatcatatagtttggcagcgaacgcgcgagaagtgaacgcacttgttcagcattcgtgcctgcttttacgctgatatagccaaacagctctttgctcccggtctgggctgtacgtgctaacactgcggcttctttgaccccgtctatttgacgaagtgctgattcgatttcacccagctccacccgatagcctctgacttttacttgatcatcaatacgcccaacgtactcaattgtgccatcaggaagccagcgcgccagatcacctgtgcgatacagtcgatcgccaggtgcaaatggatgtgggacaaatttctctttcgttaaatcaggacggcccaaatatcctctggcgacgccatctccgccgacacaaagttcaccgacagctccgaccggctgcagcactccccattgatttaagataaaagcggtggaattaccaaccggccgcccgatcggaatggaaagttcatatgttttttgaatgtgaaggcatgtcgaaaaagttgtattttcggtagggccatatccattccatatagatacttcagggcagacatttctgattcgattgacgtggctcggcgacaaagcttctccgcctataatcaaatgtttcagctgtgaaaatgtttgttcattttgttctgtcaaatgattgaatagagaagatgtcagccaaatcgttgtgattccttgatgttctatgtacctcttaagctgatgggaatcgagaaatgtttgttgatcggacagatgcaaagcggcaccatttagcagcggtccgaaaatttcaaatgacccaacgtcgaaaccgattgatgatgtcataagaaggcggtcttcaggtgtaaatgtaatataattgctgttttttacaagacgaattacacttcgctgctcaatcatgacaccctttggtttaccggttgatccagaagtataaatgatatatgcgagtgaatgtggccctgctgaagaatcaacgttcttcgtttttccttgcttttgaatatcttcgattatgatttgttcacattcaatgtctaatagttgtttttctgttttttcagattgaaggagtaatgccgccccgctgtctgacagcatataagctattcgttcaacaggcagatcagaagcaataggcagataggctccccggcttttagaatgcccagcattcctgcaatgagttctggtgttctgcctgtcaacaaggctacaacactatcaggccctacgcccttaatctgtagaactgaggcaatttgatttgcccagctgttcaggtcctcgtaagtaaatacttgggtgtcgctgacaattgctacagcattaggcgtttgttcagcctgcatttcaaagagtctgctgatggtttcatttcttggataatctatttttgtacgattgagctcgtggataaggtaatgggtctcatcctcattcaggatatttattgttccgagagcggctttgttgtctttgatgatggagagtaacatattgatgaagtattgaagccacttttctatcgtttttttcttatataagtcagtactaaactccatttggaacgtcagcaaaccgtggagctgttcctgggcatatagggttaaatcaaatttggacgtttgatgcccattgtttgctgcaggtttgagacaaagttcatccagctccaacgattcctgatccatgttttgaagaacaaacattacgtcaaacagcggatttctgctcatatcccgtgtcaattcaagcttatcaacaagctcttcgaacgggtaatcctggtgctcaaaggcttccaatgctgtctcacgcacttcctgcaaatactgtacgaatggcttcccgccctccgggcgtgtccgaagcgccagcgtgttcacaaacatgccgagtatcggctcaagatccttgtgcggacggccggcaattggcgagccgacgatgatatcttcctgtccgcttaagcgtgacaagaacgcggtgtaagccgcaaggagcaccatgtacagtgtgcttccgttttctcgtgccagcttgtgaaggcctgatgtaacctcttgatccagcgtaaatgagaccttgtcacccgtgaagcttcgcacaggcgggcgggcatgatcagccggaagatccagcacaggcagctcgccctcgagctgcttcagccagtacgccccctgcgttttgtacgcgtgccctgttttaaatccttcttgccatacggcataatctttatattgaatgcgcagtgccggaagcttccgattattgtacagttcgccgaattcccgaatcagaatgttgacggaaacaccgtctgaaatgatgtgatgcatatcaaccagcaataggtgccgctcatctgatacctttacgatttgggcacggaacagcggcgcttggctgagatcaaacggtttgataaatgcggctgcggcctcctgttcggttcgtgcgccgagaactgtagtctgtaacgtaaacggcgcctcgtcatggatgcgctgcaccggatcgcctcctgcgtcctgttcgaaggaggtccgaagcgactcgtggcgcttgatcagctctttgaaagctctgtccatcctttcagggttgagcttcccttcgagctctaacacagccggcatattgtagcctgtccctccgtcctccagctgctgaaggacataaatccgcttttgggcagaggaaaccggataggtttcctgtttttcagccggttttatcgcttcatatggactgtccgttccttcacggataacggtagccagcccttctactgtcggatgggcaaacacctcttttagcggcacctgtacatcgaattcttttgagatccgtgagacaagcgccgttgcttttaaggaatgtcccccgcggtcaaaaaagttgtcgtgaatcccgacagggccatttttcagcacgtcctcccacagctgagaaagcttcatctcagtcacgtttctcggcgctgtgtaggtctccgcatctgccgctccgtcaggagctggcagggcgtttcggtcgagctttccgcttggcgtaaccggccactgttccatctctatcatataggctgggaccatgtagcccggcaacagtctctcaagctgcgctcggatttcgtttctttggagcccttctacataagcgcataattccggctcgccgctgtctgtccgtacggtaacggccgcctcccttacgccttctatgcttcttagtgccgcttcaatctctcccggctcaatccggtagccgcgaatttttacctgatcatccaaccgtcccaggaattcaatattcccgtcagggagccagcgcgccacgtctcctgttttgtacatgcgttcccccgggtaaaacgggtcttcaagaaaacgctcctccgttaatgccggccgattcaaataacctctggcaacacccgctccggcaatgtacagttcgccggcgacaccggaaggctgtacggctaaatgcggatctaaaacatacaaacgcgcaccgggtacgggcttcccaatcggaatccgcaagcggtccctgtcccgttctggatccaatacgtaaaatgccgcgtctaccgttgcttctgtcggcccgtagccatggattaatgatacctgcggcaatacagaagcaaaacgggctgccgtacgcggcgcaagcggttcacctccggcgaatacacgctttaggtttgtcccgtcaccgagcgctaacatttccgcttgatcgagaaagctgttcagcatagccggaataaaatgagccgttgtcactttttcctgatgaatggcttgtacgatcaacgcggggtctttttcccagccgggcggaagcagatacgccgaagcaccggaaagagcccaccaaaacagctgccacacagacgcatcaaaggaaaaagaggttttcaccatgacaatgtcatcttccgaaagcggaaactggtactgcatgccggtcagaaaggaaacagcctggcggtgctcaacggccactcctttcggctgcccggtagagcccgatgtatagatgacataggcgagagatccgtcgctaacagaagcagacacatgacgttttacttcttcacgatcaagagatgtcatgtcaacttcaagcgtctctccagaaaagctcggtgcggagcatcccggctgtgtcagcaagagtgatgccccgctgtctttcaacatgtagctcagccgctcttccggatacgcaggatcaagcggtaaataggcccctccagccttcaagacagcaaggacagcgatcagcatgtcaggtgagcgttcggacaggacaccgacgatactttcgtttgtgacgccgcgtgccgcaaggtgcgcagccagccggctggcgtacatatcaagctcagcgtatgtcagcgaaccgtcggaaaatcggatagccggccgctccggtgtgactgccgcctgtcgctcaaacagaccatgcaaggttggggcttcaggtgaaacagatactgtcctgttattttgagaaacgattttccgtgttttgtcctcatctagcaatgtcatctttgacacaggaagagatggatcagagatgacgtcagagatcatgtgctgtaaataatcttttatttcagacatcatatttggttgataagcgcctgtatgaaaatgaatccgaacgtacaaagtacgccctgggatcactttgacactgcatctataattagttacctcttccatctcaaaatctttcacggagaaatcaaatgatccagcttgattcagctcttcaatctcttgttgagtaggtgtattttcaaagacgataatatgatcaatcagctcttgtttaagagcgctctgcgcctgaatgtcatataaagggaagtaactatacgcttctgcttcagtcatgtccttttgcattccactgactaggtcagaaaaagacagaaaatcactttggactcgaataggaatggtattgataaaaagtccgaccatgttttccacatcttttagctcagaaggtctgcctgatataactgatccgaacacagcatcgtcgcggcgattgaacttttggagcatgattccccataaagcttggaaaacagtgttaagtgtcgcaccacatgctgcagcgattttctgtaattcggaggtttctttttcaggaatggtaaacgtgatctgttgtaatgtcccatccgacatttgatctgttcttttaggcagaggcgaagctttttcgaaatgctgaagcctctttttccaatactcagctgcttcttcccggtcttgctgcatcagccatttaatatacgtcccgtacggctgtacgggaggcaaattaggaaactgcccttttccaagcgcttgataaatatggagaaagtctttaatgacgatgcctaaacaccagccatccattaaaatatgatggtggctccagatacagacataatgatcaggcgcccattttaaaatagatattctcatcagtacatccgtttggagatcgaagcctttggatttatcctgctctttgaatgcctctgtacaatgttctttatctttttcattgagatgagaaatgtcttcaacatgaacatggcaatgacgttgcttgagcacgacttggcgaggtttggctacatttttatagatgaatgctgttcgaaagatatcgtacctgtcaaaaacagcatccatacttttctgaaaacgctccaagtcaagctgtccatggatcgtaaaagaagcctgttcaaaataagctctcgactgttcatcatacagtgagtgaaaaagcatcccttcctgcataaatgacaaagggtatatatcctgtatttcgggttgctgcggcatcagtgaatctcctctccctatagtttgttgacggctcccataatctcactcaattcatcaagcgttaagtcttcatcagtgaaatcagatgcgctccattctcggttttctttgcccgtacaatgctcaatgatgttttccagtgtctgtttaaaatgcccggcaaatgtttggattgttttttcttcgaattgcagcctgttatagatgatgtgcatgttcaggcaccccgaagaaacggcgccgctgatatccagtgcataaggacgctcccagttcgggctgatctcatttcctggcttgatgtcagacacctcaaaggcatttgattgaatatcctgatcaaactggcctaaataattaaagctgatttctgggctgtttttctcagagccccatcttttgctgatatatttcagcacgccgtagcccgcgcctttatgcggtatacggtgcagcatatcttttgtctgtttaataaggtggcccagccgctcttctttgtccttatgatcggaatctctcatatcaagccacacaggataaatggaggtgaaccagccaacagttctgctaatatcgatgtcctcaagatatgattcccttccatggccctccatgctgattttaaattggttatttcccgtccatttctgcaaagcaaaacctaaagctgtcagaaggatatcattcatctccgtgctgtaagctttatgtgcagccgttaatagtaattctgtgtgatggcgagatagctcaaaatcaatcacttctgtatctatgaatgtgttagatgctgcgtcattgtcttttggaacaggctggatgtgacggttctcgcactcatcccagtacgctgcttcgcgctgcatctggcggcttttagagtagtcaactattctttgagaatacgttaaatatgaatctgttttttgcggcagtttaatagattctcctgagactgcctgtttgtaagcagctgaaaaatcctcgaacaaaattcgccaggaaaccgcatcaacaactaagtgatgaatcgtcagaaataaatggtcaccattctcggttctaaacaatccagcatgaagcaaggggccggtttccaaacgaatatgttcttgcatccggctggctgcttcctcaatcgtgtaccgtgcttctgttaggctatcctttacatcaaacagttcaagtgcatatagctcctcatctgaaagatctatccctctgtttatctgcacctgcctgccatcttcatgccggcatacgattctcagtgcatcatgatgagtcacaaggctttttagtacttttctaagcgcagcctcatcaaatcgttcagcccggtagatcataacggactggttaaaatgatggctttccagagattgcgagaaaaaccactgctggataggtgtccaagtaatctcgccttcgaccgggccttggtcaatggcgcgtacgtcttttcgaacccgggcggacagttcaccaagagtctgatattcaaacatctcacgtactgtcgtttcaaatccgcgctgcttcagtctggcacaaacctgcagcgctttaatagagtctccgccaagctcaaagaaattggcgcctacacccaactcattcacattaagaagctcctcccaaatttcagccatcaccgtttcaatctcatttctaggactgatatcatcagctgtataagcgtgtttttcaggttctggcagggctttctgatcgagctttccattaacagtcaccgggatgctgtcaatttgtatcatacgggcaggcagcataaagtcaggcaaggcgttttttaggtaagcccggatgtctgatatattcgcagcctgttgatctcttatcaccatataagcatatatagctgtttgcccttgctcgtctgctctggtaatgacagccgcctctttaatcattggatactgaagaagtgccgcttggatttcgcctaactcaatacgatgccctctgactttcacctgctcatcaatgcggcctaaatattccagctcgccatttgacaggcgcttagcaagatctcctgttcggtataatctgtctcccggaagataaggattggatacaaaacggtcagcggtcagctcatctctgttgagatatccccgtgccacaccttcgccgcctatatacagctcccctggaactccgataggctgcagattcatatgagcatccatcacataagcctgcagagttgaaagcggccggccgatattgcttttattttttgcaatgtctgctgcggacaattttttgaatgttacatggactgttgtttctgtaataccgtacatattaatcaaatcagtgtgaggatatttttcattccagctttgaagcaatccgggctgtaaggcttcgccgccaaaaatcacgtagcggatgcttaaatgatctgtatgattttgatcttcaagcatcaagccgtaaaaagcagtcggggtctgattgagtacagtgacgcgctctttttttaacaataaacggaatgcataggggtcacgggctgtttctttagagaccacgactaatgtacctccgttcaataacgcaccgaacatctcccatacagagaaatcaaagcaataagaatgaaataacgtccagatgtcttcatggttaaattcaaaaggcaggttttgatgcttcaagagactgatcacattgcggtgctcgacaatgactccctttggctgaccagtcgttccagatgtgtatatcacgtatgcgggctgatccgttactatttcttgaatgtttacatcagccggaattgagtcgttttcacattcatcgatatgcataatatgcccggtgtagtctgcaggtttgttttgaccgcgctctgtcagcagcagttttgctccgctgtcattgagcataaagctaatacgctcctgaggatattcaggatcaatcggcaaataggccccgccagcttttaaaatcgataaaatgccaatgatcatatcaggtgaccgatcgagcatcagaccgacgatatcgccagttctgaccccttgtttgatcagcatagcagctgcccgctcggctttttcattcaggtctcgatacgtaagctgagaatggccgcacaccactgcgatatgctccggatactgagcggcttgcttttcaaataagcttactatgttttcatttctcggataagccgcatactgccccattttttcaaggagcaacctacgctctgcagcaggaagcaattgcacgtccgaaattctcatctcggtatccgccattacccctttcaccaattcaataaaataggatgcccaccgcgtaatggtttcttcttcaaaaagagcagtgctgtattcaaaacggcagcgtattccactcgggtgctcttcagcgtgtaatgttaaatcgaatttggatatatcatgtttaggagtgacagacgaaatcgacagaccaggcacttcgaaccggaaatcttcactgctgtgaagcacaagcatcgcatcgaacagcgggttgcgatttacctctcgatttgtatcgagcttatctgccagctcctcaaaaggataatcctgatgctcgtaagcggtcagagccaggtggcgaatgtcctgcaaataggagctgaacgttttgtggccctcgggcttgcttcgcatcgccaatgtattgacgaacatcccgatgacgcgctccagatcagcgtgcggtcttccggcagcaggcgaaccgacaacaatatcctcttgcccgcttagcttagataacaaaatagaatagacagccagaagaatcatatacaatgttgttcccgtttcagccattaaacggtgcagctcatcagccgtgtctttatcaatgttgacttcaattgttccaccgctgaaatcagggagacgcggccttgttttatcaagcggtaattctagtgtaggaagactcccgccaagctgaccgagccagtaggcctcctgttttttgtatagctctttcgggtacttctcttgctgccaaacagcaaaatccttataatgcaggtttaaagctggcaactcttttccgcaatataagtcagtaaattcttggacaagagtgctcatcgagacaccgtcggcaataatatggtgcatatcgagcagcaaaaagccgcggtgattgccgattgtaatgacacatgctctaaaaagcggaccggatgatagatcaaacggtttgataaaggtctcgattgcagactcaagcatttgttctgattccatttcaagctcttttagatcaaaagctatctctggataaatgatctgtacaggctcgtctctgtcaagcacaaaaacagtccgtaatgcttcatgccgattcacaagttctgtgagaacgcttctcaaccgctggcgattcagatttccgcgtaattcaagtacagctggcatgttataacctgtgctggcatctgccagctgatgaagagcatataatcgtttttgcgagaaagacagcggatagacatctctttgatccgcaggttcaatctgtgtaaaagcgtgttcttttaagctcatcaatttgaccgccatgctttcaaccgtcggataagaaaacacctcactgagcggcagctcgacattaagctttttatgtattcttgataccagtgcggccgcttttaaggactgtccgcctaactgaaagaaatcatcacgaatgccgatgtgctgtttattcagcacatcttcccaaatatgtgcgagatcagcttcgattaaggttcggggcgccatatatgtgacactcgtattgttttctggttcaggaagcgcaaacctgtcaagcttgccgctggatgttaatggcatccggctgatgttgataatacttgctgggatcatataggacggcaatgtcccggcaagatgctgatacaaatctgggaggctgtttcccttttcgggaacgatataagcaatgagctccttttcctcagcagaaacatcacgggccagtaccgcggcttcctttaccccggtgcttgtcgaagaactgtttcaatctctctcagttcaatacggtaacccctaatttttacttgatcatcaaaacgtccaatatattcaatcgttccatcaggcaaaaagcggcctgcatcacctgttcggtataaacgctccccttcaaggaatggatgatcggagaatgctttctgtgtcagctcttgctgtttgtagtatcctctcgcaagacccacgccggaaatacacagttcacccgccgcgccgatcggctgcatttgatttccgtgcaaaacaaatacttttgtgtttctgatcgggtgtccgatcgtgatcctctctttttcattcagatgccgcaatattgttgttgccacactgttttctgtgggcccgtattcatttgccagttcagcagaaggacaaattatttgactcaactcaagcagatcaggcgtgaccgcttcacccgcaaatgtcacaatacgaagactttttgcatcgtcagcagtcatcacttccaataacacccggtacagggaaggaacaatgatcatgtggctgaccttataacgggctatttttcgcttaagggccagcacatccttcgcttcgtcatctgttgtcagcagtacgcacgcaccagataaaagcggagtaaataagctcgttacacagccgtcaaacacgtacgaaaacaaatggagggatatatcctgttcggtcatgccatactcttcccgtctccattgcaatgtattggcaataccgtgatgatcaactaaaacccctttagggcgccccgtcgttcccgaggtatagatcaagtaggctaggtcacctggcggcatatttggagcttctgtttggtaactttctgtatgttctatcattattgtatttccttcataggacggagggatcaaggaaataaggtcttcttctatcagcaattgagccgcttgactgtccttcagcaggaaagaaagacgttctgctggaaaatgtggatcaagcggcatataagcgccgcctgctttccaaatcccaagcagagctgcaggcatttccattgaccggcccatcattacagcaacgatatctccagatccaacgcctttttctatcagagcgtgcgcaatctgattggctcttacttgtaactggcgataggtccagcattcgtctcccattttcaatgcagcagcttcaggtgttttgtgagcttgttcctcgaacaattggggtatcgttttgttcacataaggacgctcagtttcgttaaacaattggataacctgttgctcctccggcggcacgatattgatgtcactgacggcaacatcgggatttgtcaaaatgcaatccagtgcttgctttagatgcccctgaatcctcagcatctcctcccgctcgtaaacgtctgcgttgtagctgaatttgatataaaatgattctcccggaacgataacgatattaaagtcgtaattggtttgttccgacattgaaatgtcactcagcttcagagcgccttcatcattttcactctccacgcttaacgcctgatgaagctgtacagggtaattttcaaaaacaaaaatatgatcgatcaacccttgcttcaatggactatggttttgaatctcataaagcggataatacccatgctgttcagatgataaaatatcctcctgcacggctttgaccagcgaagaaaacgttatgccttccgcagatcggattcgcactggaacagtattgataaacaagccgaccattgattcaatcccgtcaatcgctgacgggcgtcccgaaatgacggagccaaaaacggcatcatctgcagcattatatcgatggagcagcacgccccaaatactcataaacagcgtgtttaatgtcactccccagttttgggcagcctctgtcagtttctcaaccatatccggcgctaatgaaaagctgacctggtcggctttataattcccgtctgccgtgcggcgctttattcggggaatagaagcagtattgccgtactccttcaaatattcgctccagtaggcagcagtctcttcttgatcttgttctccgagccattcaatataacggctgtacggcaccgtgctgccaagctgtacaggtgagttatttttgagcgaatcatacatgctgaaaaactctttaagaataatgccgagacaccacccatccatgatgatatggtgatgtgtccagacacatgtatattggctgtctcctctatcaaaaagggcaagacgcattaaaggatctttttgcaaatcaaatcctttttcccgatccttagtcataaaagcatcaatcagcgtctgctgttcttgatcagccaggcgagaaatatcttctctatatactgtcaattcacggtttgatagaactacctgctgcggacctgtaagatctggtacttctttaatgaaaatcgttctgaaaatatcatatctagaaacaagaaggtttaagctcttttgaaacgagtcgacgcatagattccctgtgatcgtaaacgaggtctgttcgatatatgctttcgagctgaaatccattagtgaatgaaacagcattccttcctgcatgtgcgataacggataaatatcttgaatttgtgccgattgtgccatcaattccacacaccttttcaaaagttaaagatctttcaccagatcttcgatgctagataatgcagacaacgttaattctttattgctgaaatcgctcaatgttttttcgcgtgcttttttctgcgaacaatgctcaatcgtctcgataagatgcctgtgaaaacgatccataaagcactcaattgagtgtttgctgaacacttgggtgtataccgcttttacgtgaagccgtccgtccgtaatgagagcattgatgtccagctcatactctcgttctctctcacccgctatttcgtaacggggctggtaatatgataattgaaacgtttcaacttccttctcttcgctaaattgaccgagataattaaagctgacctcaggctctttatgccgcagttctcctatgtgtgttaacaatccgtatccagttcctttgttcggtactcttctcagcatatcttttgtcgtcttaattcggtatgcgagctgatcctcgaaaggctcgggaatacccatgtctagcagaataggataaatggaagtaaaccatccaactgtccttgaaatatcaatgtttggcacatgcccttctctgccgtgtccctcagtgctgatcacgatttggtcatgcccagtccattcagaaagcgccattcctaaagccgtaagcaaaagttcgttggcatcagtaccataggcttgctgggtttccaacagcaatttttcagtccagtccccggatagtacaaacgctgctgcgtcgctattcatttggagtctgtctggcacattttctatgtccttaggaagaaaagcagtgtgagcgtctaaaatcgtttgccaatacgttttctctgaaagcaattggttactttcagctatttgggtaagaccatcggcgtaggataaataagaatccgtttttggcggtaattggatttctttcttttctaaagcctgttgatatgctgcagctaaatcctcaagcagaattctccaagaaacgccatctatcacaagatgatgaagtgcaatcagcaaatgatccccttctgccgttttaaacaaacctgcttgcagcaaaggccctttttctacattcattttgctttgaatgacggtttcctcagcggcaagtttttcatcaaggtgagtcctttccagcgatgcttttgtccaatctgaaatataaaggccaaacagttcatgatccttgtgattgattccgcgattaaactgaatgacatggccgttttggtcacgttggaaaatcatgcgaatgccatcatgatgctcggttattttacgcagcgctagatgaagcgcgttagcattgaatcctttttcactgaaaagcatgacggactggttgtaatgatagtgaaaagcatatacctgtccgaaaaatcttcgctgaatcggggtgagttcagcttcaccttccgcaggcccctgatccgcttgagatgccaatggtgtgatatgtccgcatagttcctgaatcgttgaataacggaataagtcgcgtattgtcatgctccagccttcagctgccagacgtgctgccacttgtaatgctttaattgagtctccgccaagctcaaaaaaggaatcgtgaatgccgactcgtggtatgctcagtacatcttcccatatatacgccatcgttttttgtatgtcgttaactggtgcggtatatggacgcgataacacattatttggagccggcaaggcatttctgtccagctttccgtttagggtcagcggcatgttttctaaaggaatcagatgtgcaggaatcatatacgctggcagctcctttgttaaagcagcacggagagcattcgtattgacgtctgaaggcacaatatatgcagccaaaccagcctgtccattcttatcatgctgaacggcaacagcagcttctctgacaagcccagtttgaagcagaacactttcaatttcttctgtttcaattctgtatccatttatctttacttgataatccattcggccaagaagccggatcgttccgtttggaagccagcatgctcgatcaccggttctgtacagcctttctccagagacaaatggattttctgtaaatttcatttgcgttaagtcaggtttatgatgatagcctttcgcaacacctgccccgccgatgcacagctcgccggcaacaccgatcggctgaatttgatcagtctggctgagtacgtacatgtgtacattcggcagcgggctgccgattggcacgttatctcccgtacactctccacccacactggtttcatagaagctcgaatcaatggttgcctctgtgacaccatagctattaatgatgcgcatgctttggccaaagcgatctgtcaatgttttgaaatcttgagctttcaccatgtcggaaccaagaatcagtatgtctaagtcaggaagcttgaactggttacggtatacatactccatcaccgggataatgagagccggtgtcgactccatcaccgtgattctctgagagttcatgattttatatatttcagcaggttccagccgtgtttcatctgggcaaacgattagagtcccgccgttggtcaatgttctcgccaaatctcctgagaagacatcgaatgaaaagctcgcgatttgaagcagtctgacaggcttccgatccagctcatatatttgacgccaagcaagagcagcatgagtaaagttccgataggtgacaatgacgcctttaggcgcacccgtcgttcctgacgtataaatgatatataccggctcttcaggagcaggagataagttaaggttgcagttactttcttcataagtgctttcatcgtcaaggcagatatgagacatctcagattcaggcaagtttgaaatcaaatgcttcaactcctgctgtaaaagaagaatatctgccccgctatcacgaagaatgtattcaatacgagcttttggataatgtgaatcgattgggatatacactccgccagctttcatcactgccagcacgccaacaattgcatcgatggaccgcttggctaaaacagccacagttggcttcggtccttttctgttttgcaatgttcgtgccagacgattggctctttcatttagaagccgatagctaatctctgtttcgttatcaataacagctatatgttctggaatttcttcagctttcgcttcaaatatgtgatgaaaaggaacatctttttgagcaaattcaacctgagttttgttaaatccaaagactattttttgtttttctttatcactaagtatgtttatttgtgcaaggcttgtttcaggagttgaaagtgccgcatgcagaaattcggtaaaatgatcggcccagcgttcaattgtagctttcaggaatacttctgtactgaattccatttcacagcaaatagatccatttatttccgtagctattaatgtgatatcaaataaggaaatgtgatgtgcgaaattggcaggccggacttttatttctctcagatctatgtcttgtttttccacattttgaaggataaacatcgcatcaaacactggattccggctcatatcccgtgtcaattcaagcttatcgacaagttcttcgaacggataatcctggtgctcaaaggcttccaatgctgtctcacgcacttcctgcaaatactgtgcgaatggcttcccgccctccgggcgtgtccgaagcgccagcgtgttcacaaacatgccgagtatcggctcaagatccttgtgcggccggccggcaattggcgagccgacgatgatatcttcctgtccgcttaagcgtgacaagaacgcggtgtaagccgcaagaagcaccatgtacagtgtgcttccgttttctcgtgccagcttgtgaaggcctgatgtaacctctggttccagcgtaaatgagaccttgtcacccgcgaagcttcgcaccggcgggcggacatgatcagccggaagatccagcacaggcagctcgccctcgagctgcttcagccagtacgcctcctgcgttttgtacgcgtctcctgttttgaatccttcttgccatacggcatagtctttatattgaatgcgcagtgccggaagcttccgattattgtacagctcgccgaattcccgaatcagaatgttgacggaaacaccgtctgaaatgatgtgatgcatatcaaccagcaacaggtgccgctcatctgatacctttacgatttgggcacggaacagcggcgcttggctgagatcaaacggtttgataaatgcggctgcggcctcctcttcggttcgtgcgccgagaactgtagtctgtaacgtaaacggcgcctcgtcatggatgcgctgcaccggatcgcctcctgcgtcctgttcgaaggaggtccgaagcgactcgtggcgcttgatcagctctttgaaagctctgtccatcctttcagggttgagcttcccttcgagctctaacacagccggcatattgtagcctgtccctccgtcctccagctgctgaaggacataaatccgcttttgggcagaggaaaccggataggtttcctgtttttcagcgggcttaatcgcttcatatggactgtccgttccttcacggataacggtagccagcccttctactgtcggatgggcaaacacctcttttagcggcacctgtacatcgaattcttttgagatccgtgagacaagcgccgttgcttttaaggaatgtcccccgcggtcaaaaaagttgtcgtgaatcccgacagggccatttttcagcacgtcctcccacagctgagaaagcttcatctcagtcacgtttctcggcgccgtgtaggtctccgcatctgccgctccgtcaggagctggcagggcgtttcggtcgagctttccgcttggcgtaaccggccactgttccatctctatcatataggctgggaccatgtagcccggcaacagtctctcaagctgtgcccgcacttcgtttctttggagcccttctacataagcgcataattccggctcgccgctgtctgtccgtacggtaacggccgcctcccttacgccttttatgcttcttagtgccgtttcaatttctcccggctcaatccggtagccgcggattttcacctgatcatccaaccgcccgaggaattcaatattcccgtcagggagccagcgcgcaacgtctcctgttttgtacatgcgttcccccgggtaaaacgggtcttcaagaaaacgctcctccgttaatgccggccgattcaaataacctctggcaacacccgctccggcaatgtacagttcgccggcgacaccggaaggctgtacggctaaatgcggatctaaaacatacaaacgcgcaccgggtacgggcttcccaatcggaatccgcaagcggtccctgtcccgttctggatccaatacgtaaaatgccgcgtctaccgttgcttctgtcggcccgtagccatggattaatgagacctgcggcaatacagaagcaaaatgggctgccgtacgcggcgcaagcggttcacctccggcgaaaacacgcttcaggcttgtctcgtcaccgagcgctaacatttccgcttgatcgagaaagctgttcagcatagccggaataaaatgagccgttgtcacgttttcctgatgaatggcttgtacgatcaacgcggggtcgttttcccagccgggcggaagcagatacgccgaagcaccggaaagagtccaccaaaacagctgccagacagacgcatcaaaggaaaaagaggttttcaccatgacaatgtcatcttccgaaagcggaaactggtgctgcatgccggtcagaaaagaaacagcctggcggtgctcaacggccactcctttcggctgcccggtggatcccgacgtataaatgacataggcgagagacccgtcgctaacagaagcagacacataacgttttacttcttcacgctcaagagatgtcatgtccacttcaagcatttcgccagaaaagttcggtgcggagcatcccggctgtgtcagcaagagcgatgccccgctgtctttcagcatgtagctcagccgctcctttggatacgcaggatcaagcggcaaatacgccccgccggccttcaagacagcaaggacagcgatcagcatgtcaggtgagcgttcagacaggacaccgacgatactttcgtttgtgacgccgcgtgccgtaaggtgcgcagccagccggctggcgtacatatcaagctcagcgtatgtcagcgaaccgcctgaaaagcgaatggccagccgctccggtgtgaaagctgcctgtcgctcaaacagcccatgcagggtgaaagctttaggcgaaacagcttccgtcttgttaaactcatacaacaatttttgcttttctcttgtattcgtcatatctaattctcttataaagctgtgcggatgttgaagggcgttttccagtatggtaagcagatgagattgtattcgtttaatatcctcaagagaaaacaaggtattttgatagtcgaaatttaattgaatggttccattgtctatccgttcttgtatttgaactgaaagctcgttcgcggtgtatccgctgaaataaagcgctgtttcatagtcaaaatcatctgcattatgccactgaagtggctgatactgcatagatataccgataaggttgtgtaaatccttctgttcatttcttaattcatttacaagcaaattataaggaaaccgttgatgacgcataacagaaagctgttccctgcctattgtgcggacaaaggaaagaaaatctgtgtcaggatcaaccgttattctgattggaagagaactaacgaacatgccgagcatttctttttcagcctttgaccctctgttgccatagtaggtgccaatggcaagatcttttttagaagtgattcggctgatgcatatgtaaaatgaagccataaataaggaaatgatattgatcttgtgtgcttcgcaaaagattcgaatcgtttgctctagatcaggtgaaagaatgatggtgtctctggatgcagatgtgctctgtttttgtaaggacgtctggtcggctaacgagtggtattccaacgggtgctcaaaggtttgcgtccaaaataaacggtcctttacaaaccgcggagattgtagatattgactctctttttcgatgtagctcaagtaagaaggttccggctgatcaggtaaaggatctttctttttcattttttgataaagatctataatttgatttcccatcacatttaaagagattccatccattatgatatgatggaatttcgcaaatagccaaacttcatgagagtcaattctaaggaggtaaaattgataaagaggcgagttgaacagtttaaatggaatgctcgcttgatcctgaatccattgctctatttctatcatttcaacatttgaaaaatcaattattctaagtggataatatttatattcagtaaggtgcaatcgcggctcaagctcttctccttctaacagctgaaatctaatggcgtcgttgcgggagatggaatgattcagcgctccctccagagtatcaagcttaatattgcctttgaatttcacacaggctgtgagattgcaaatgctggtatctggctccagcagttcggtaaaccacactctcctttgggcatgggttaaagaataagtatgttcgctcaacggattccctccagttctcataataagaggataagaaaaagtagaaaaaagcagaaaaatgtcaataaaagaaattatatgactatataatccatatatgcactatattaacggatattttttaaagtacaataaaaaacattaaatttttataacatttttttgaatatagtattatttctttatttttcgtttctttttttatcaaatttccggatataaagtgataaaagtattgttttacataaggtcttatacactactttttaatcgaactaattttcttttgtgcatcattcttctaattgttggaaggttcgacaaagcgttattacagacataaaaaaacctgttttctcttggaaaacaggtctgccgctattattgatttgccaaaatgacagcgatttgatcctcaatatcttttccatcctcttcatcaatcaatccatttagaagaatagagaaaacaagtttttttccgctctttgtttctgcgtaccccgatagagagcttaccgtactgagcgatccggtttttgctcttacttttccttgtgcaggagtgtctttcatgcggtttctcagcgttccgcccaccattctgtcaggattgcccgcaacaggtaaagaatttagataagccgcgaaccaactctgatcctgaatgtcatataacagctgtgaaagttgatctgaggatacagcatcaatatgtgagattcctgatccgtcccttaagacgagtgatttagaatcaacaccaaattccggaagcgtactgtttaacacttcgagccccttttcccagctcccttctcctttttttactttccccatctcttttacgagcacttcggcatgtccgttattacttaatttcatgaacggcacaaaaagtttcgataaaggcattgagcgatgagagagcagcacatctgaagaactaggtgcttcacccgtcttgatgttccctttcacagtaattccttgtttttttagtgactgcttaaataaatctaaggcatatccggcaggctcccagacagaaatccattcctttgtcttgtttgcgtcaaccggtacgctcccttcaattgtaatcgtgtttgttccatgctctctttcgattgtgaggtctttatctgaaccggcagcagtcgtttcagcatcgttctttatcgttatataatcggttttcggagagacagacacggcaggctcttccccttctttttgatttggggtgacttcaacaatcacagtgcctgcatcatagtcttcgtttggagacgctgttagagcggagattggcgcgccataatatgtgtattcatcgctccaaggcatatcaggtgataatcgcatgtcatcatgccacgtatcatcaccgatcagattgcctttaattacttttacgccggaatgtttcaatttctcagccattttgtcaaaatcagatggtaaaagtgtcggatcgcctttccctttcaaataaaggttaccattcagctttttccctttcagtgttccatccgtccggacctcggttgtaaaagaatagttctcgccaaggacagaaagtgccgcggccgctgttaaaagctttagagaagaggcaggcctcattcgggtgtctcctgaatgttcatatagaacagcacctgtttccgcagagcgaacggtgatgccggccattgcgccttcgagggcaggatgatcagctaaaatcttatcgatctgcccggaaagtgcatcttgtttttcagcggcaagcgcagcctgatgcatataaggcaccgaagcaacgacgaaaagcagtaaaacagcaacataaagctttatgctttttttcattaatttccccgcctctctgcgcttcatcattggctattgatgattcagttcaatggtgatactgcttttagctgttgtttcttctcccggctccagcacttgtaaaccagtgagtgacgaaggtaaatcaagattcactgcgtttgtcacccatgtgtaaggttcagggcataaatacccttgttttccgtccgcattgtatacaacccaatgtttaaactgttcatctgccttataaataatgctgatatgtgcatgctgatgataaatgactgcctggttttctccgcccctcttctgataagaagataaaaagacatcatccagctgcttgtggcgcaaatccattccttcatgcaaagcttctttattcggtacatccatcagtttcccggtcggcagcaggcgttcatccaactcccattgctgatctgctgtcagggagaataacgagctttctgccggaaacacaaatgtagtatgataaccaattccccaaggaaacgcttcctttcctttgttcatgaccgtcgcatgtttaaatagagtattcccctttaccgtgtatgtcatccgaacgacggcatggtgaggaaattgcttatacacatgggggagctcagaaagatcaatttctgtttcaacaatcacttcttcatcagttttcttcgcggtcactacgttccacttttcatggtaaagaaacccatgaagatggttgtgtttatccttctcgttgatatcaaaatgatacgttctgccccggaaactgaatgtaccgtcacttatgcggttaggcgggaacaggattggaatgccatacaatgttggtgtgtcgtgaaaactttctgctgtttccggttcacgcaaaagctgaacttttgttgtgttgtccacgagagaaataacgttgctcccccactcagggacaacaatcatttctagatgttcgttgcccgctttgatggccggcgttcccaaatacgtgattttctcaataaagtttgccatgtttactcaacctctccttgattcattgctagtataagaattcaatgtactgtaccatatttcctccattttatattttcccctatcaaataaaaaaacaccgttcaaacttatgaacggtgtgattcgaaggctattggatgagacgtgtgatttgtttctttttccagacgaattgataatacccataaatcaacagcaagctgacggcaaacgcagctggataaccaacccagacgccgagtatttcaagctttgtatagtgagaaaggacgaaagcgacaggcacctctactccccagattgcaaaaatactgatgacggtcggccataaaaccgttccgcttgcccgcatcgttgcagaaataatttgggcatttccaaacagcaaatagctccacaatgtaatcatcaaaagacggtgcgcaatgtaaagcgtctcttgctcggttaaaaataacgataaaatctgatgtgaaaaaacatagatcagaatgatcagtacgccgccaatgatataattcagccaaatccccacgcgaatgacctgctttaagcggtcaaactcgttcgctccgatcgattgcgcagcgaaaatagaaaccgcaataccaaggctgacggccggcatctgtacatagctggccacctggttgaccactccgtatgcagctgttgcattagagccgtaatgattgacgaatgaaataaccgctatctctgataatgagacaagaatcatattgatgcttgctggaaccccaagacgcagcaggagaaccagcagttccttatccattttcaaataacgacgcactgttttatcaaattgcagcgggtgttttcgctttcgtaaatacaccattaacacgagaaaagtcgcaatcgtggaaatgacagttgcatatgccgagccgtatatgcccagtttcggaaaaccaaacatgccaaggattaagacaggcaaaagcgcaatgttgataaccgtgctcacaatcagcgtataaaacggtgtcttggaatctcctgttccgcgcaaaaaggtagtataagcaaaatataaaaacataaatggcatagcataaaataaaatacgtgcatagttagcgctgacatgaatgacattttcaggtgttcccattaaacgaagaatatcgagggtgaaaatactgccgatgacggctaacacaacgcctaataaaaatgtaaacgtgagcgtcgtcccgacaacagcctttagccgttcctcatttttcgctccgtaagcttgtccgatcagaatcgaacttcctgaaccgatcccaatcgtaaatgagattaaaagaaaaaataacgggaaaaaggatgatacagctgccactgcatcaacaccgagccatctgcctacagccatcatcccgactagctggccgactgattgcagcacattgctcagcagaagcggcactaaaaagagtgacatcgaccgccaaactgatggtttgcttttcttttgagttacaagaggttcttgtgatgtttccatattaaaggactcctttatttgaaatcgtttttaaacatgccctcattttttgacaaaaacaggatatgtaacatgttattattcatcactgcacatatgaaacccttcccgattcttctaattttacacatctttttagcttatgaagaataaactagcaagtaatggcgtattttttgtgagtaaaagaataaaaaataatttatgcaaaagtattgtaatctatccgtaactattgtaacatttgtaacataagagaaagagattttgaaggagagagcgataatgaaaaaatgtcttctatttctaacaaccattgcacttattctgtcattaagcacaaatgcatttgcgaaaaatacatcaggcgatttatcacaaaaacaagcattacagttggcattatccgctagagaacatttttggaacaccatgagcggccacaatccgaaggtgaaaaaagcagtttgcccatcaggcacattcgagtatcaaaatcttcaatatgtatacatgtgcagtgatctaggcactaaagcaaaagcggtgaattacttaactcctatttttacaaaaacagcaatcgaaaaaggctttaaagattatcatttcactgtttctaaaggaaaacttgctgttccaatcggtgacggagacaatcttttgaattggaaaaaatcaactgctaaactggtctctaaaaaaggcggcacaatcacatacgaatttaccgtccctacattagacggatccccttctgcaaaacggaaagtgacattcgtgaaagaaaataaaaaatggaaagtcaatcaatttgacgcagttatataagaaaaacgcccggtataagcgggcgttttttatttggtttgcataaagaaagacaacaggcgaaaagtgcctgttgtctttttgtgaatataacgctctaggagagattcgaactcccgacctgcagtttaggaaactgctgcactatccgctgtgctactagagcttttggtatttatatagtagctctgatgatcaatattttcaaacgatttgtattaaagccctccaaaaaccttatatgcggctcttgtcgtatcttcatcaataccgatataccgcattgtaattgatggtgatgaatgattcagtattctctgcagctcggcgatgtctttcgttcgctgataaaaatgatagccaaacgttttccggagtgtatgcgtccctatctcctcaaggccgcacgccgcagcggcctctcttaaaattctgtaggcctgaatgcgggaaatcggcttcctggtccgcactgatttaaaaagatattcgttttccttcatgtctttcgtatactcgtatatttcctgtttcagcgattctaaaataagaatctttcttttctttttcgttttgctttcagtcgcccataaatgatctttattttgaacgtccttcacttgcagcggcagaatatcagaaatgcggagcgcgctgttgatgccgaaaataaacagaaaataatcccgattgtttttgttaagcaaatactgtttgacttcttggattttctctagactgcgaattggctgtacaatatgcatcaaaaaactccttaaaaaccgttatgtaacgttttgaggtctatgttactattatagctgaaaaacgttgaatgtcaaagtgcggcggcatttatgtaacataatatacatagtgttacataagcttttaaaaaagcttcttcaaaccttcaccctataaaataagctttaaagcctcttataaagcttttaacctcttggatacttatccccctgccaatcataaaaaaacctcttaaaacgaaatctgaagctcccaattttcaggagcttccgcaaaaaaacatacaaaaaaagacacaatttcaaattgtgtcctaatcctcatcctttacatcaatatcttccgggattggttcatttaatatttcctgcacaagtgctttgtaattctccagctgttcaagatgcgttttgaactgctccttataaatcaaaaattgctccccgtcatgaacggctctgattttcccttcgagcaccaagcttttaatataatcctctgaaagatttgtatattctgctgtttcttcaatcgttaaatacatatagcagtcccttcttaatccgtatgctgattctaatatagcacatggctcatatcaatataatcaattttgcacagaaaaacggctttatgcactatataatataccatttgtcacttgtgaaaacgctgtaatttttttacgctaagattgtaacaatacagcttcatataggagggagaacatgaaaagaacgtggaacgtctgtttaacagctctgcttagtgttctgttagtcgctggaagtgtcccttttcacgcggaagctaaaaaaccgcccaaaagctacgatgagtacaaacaagtagatgttggaaaagacggcatggttgcgaccgcacatcctcttgcttctgaaatcggtgctgatgtgctgaaaaaaggaggaaatgctattgacgcagcggttgccattcaatttgcactcaatgtaacagagccgatgatgtcaggtattggcggcggcggttttatgatggtgtatgacggaaaaacgaaggatacaacgataatcgacagccgtgagcgtgctccagcaggcgcaactcctgatatgtttctggacgaaaacggaaaagcaatacctttctctgaacgtgtaacaaaaggtactgccgttggtgttccaggcactctgaaagggctggaagaagccttggataaatggggaacccgttcgatgaagcaattaattaccccttctattaaactcgctgaaaaaggctttccgattgattctgtgttggcagatgccatttctgattatcaggaaaaactttcacggactgccgcaaaagatgtatttttaccaaatggcgaaccgcttaaagaaggagatacccttattcaaaaggatttggctaaaacatttaagcttattcgctccaaaggcactaacgctttttataaaggaaaattcgccaagacgctttctgacactgtccaggatttcggcggatcaatgacagaaaaagatttagaaaattacgacattacaattgatgaaccgatttggggagactatcaaggctatcaaatcgctactactcctcctccaagctccggcggtattttcttattgcaaatgctgaaaatccttgatgattttaacctttcacaatacgatgtccgctcatgggaaaaatatcagctgcttgctgaaacgatgcatttgtcttatgccgaccgtgcgtcttacgcaggtgatcccgaatttgtaaatgttcctctcaaaggcttgcttcaccccgattatattaaagaacgccagcaattaatcaacctagatcaagtgaataaaaaaccgaaagccggtgacccttggaaataccaagaaggatcagcaaactataaacaagttgaacagccgaaagacaaagtagaaggccaaacaacccactttacagttgctgaccgttggggaaatgttgtttcctatacaacaacaatcgaacagctgttcggaacgggtattatggtccctgattacggtgtcatcctaaacaatgaattaacggattttgatgcgataccaggcggagctaacgaagtacagccaaacaaacggcctttaagcagcatgaccccgacgattttatttaaggatgacaagcctgtcctcactgttggatctcctggcggggcgacaattatttcatccgttttgcaaaccattctctaccacattgaatatggtatggaattaaaagcagctgttgaagagccgagaatttacacaaacagcatgagctcttaccgttacgaagacggagttcctaaagatgtcctcagtaagctaaacgggatgggccacaaattcggcacaagtccggtggatatcggaaacgtgcaaagcatatcgatcgaccatgaaaacggcacctttaaaggtgtagctgattcaagcagaaacggcgcggcgatcggcattaatttaaaacgtaaataaataaaaaaactgtactcgcttcaaatgagtacagtttttttatacacatctttaaaataaaaactgacaaacgtctttattctgctaatgcagtgtatcagaccagaaatccaacacgtctatcttcatcttttcatttcgtttatctcatcaagaaatgtctgaaacgcactcgtaataaaaaagtctttcctgtgtataaagacgatctccaagtcttgatatgctggcggcagtttatgaatccatacatttgtacgatgctcggagccgtcaacagcggactttgggagcagcgccgtacccatcccggcggaaacaccttttataatggcctccaatgtgccaaactctatgatttttggattgtgtaggcctgcttcctctagtaatcttttgaccctgtcacgatgagaacagccagccccaaaaaagagcatcggctgctgaagcatgtcttctgccgtctcttctcgtgatgaaatcaaaactaattcatcatgggaaacatggagttgtctaactgcagcgtgttcaaccggcccatatacaaaagcgccatcaactttatgatcaagaacctgttgaatcaaatgatgcgtatccgctgtgttcactgataaatccacttcaggaaaacgcctgaggaaggatgctgcatgctcaggcagatgcgttaccgccgtcgtttccagtgatccgatccgcaaaggcccttttggttgcctgctcattcgggtcgatttttcagctttgtctaacagcgataatacttgatctgcatattgtagaagattttctcctgcagcagtcagcttcatcccccgattcgttcaatgaaacagcctgatattcaaatcttcctcaagcttatgtactcttgctgtcacattcgactgaacataattcagcatttgggctgctttcgttatgcttccttcgcgggcaacagcctgaaaaatctttaaatctccgctttccacgcgctctcacctgcttgctatgatgaaaagtgatattggctatcatatttgttcattttactcgaagaaaaccgctatgtaaaatatgtaaagatatgaaaatacaattcaatgaggaggcagacagcatgaaagctgtaattcacaacggaaaagccggccttcaggggttatcagtcgaggacgtttcatcaacaaagcctggatacggagaggtaaaggttaaattaaaatccgcgggcctgaatcatcgtgacttgtttcttatgaaaaacaaatcggaacaagatcctcacatgatactgggttctgacggcgcgggtatcatcgaagagattggtgaaggcgtgaaaaatgttactgttcagacagaagtagtcattttcccgacattgaactgggatttaacagagaatgtaccacctgtacctgagattctgggaggtccttcggacggaacacttgctgaatatgtgatcattccttcacaaaatgcaatcaaaaaacctgcttatttatcttgggaagaagcgggcgttttacctttatccgctttaactgcatatcgggctctgtttacaaaggggcaattaaaaaaaggcgagcatctattgatacccggcatcggcagcggtgtggcaacctatgctttatttatggctaaggcgattggggcaacagtaagcgtgacctcccgcagtgaggagaaaagaaaaaaggcgctgcaattaggtgctgattacgcatttgacagctacagcaattgggatgagcagttgcagggaaaaaaggcggatgttgttcttgacagcatagaacctgctctcttttcggaatacttccgccatctaaaaccaaatggccgtattgtcagctttggggcaagctcaggggataatctcagttttccggtgcgttctctattctttcctcaggtcaatgttttggaacctcgatgggaagcggtgaggaatttcaagctatgctcgctttcattgacaaacataagctgcgccctgtaattgaccggatatatcctttagaaaaagcatgtgaagcatataaaagaatgcaggaaggcagacagtttggaaacatcgggatcataatggaataaaaaaagaaaccggctggcaacaagaccggtttctcttatatgataatcccctttatttacggaagaactgaactccccatcaaatatcgatccacttcacgcgccacttcacggccttcattaatcgcccatacgattaagctttggcctcttcttgcatcccctgcggcgaatacaccatcgatatttgtttgataatccccatatgctgcactgattttgttatttactgaatcaacaccgaactgtttcaacagcggctgttctgtgccttcaaagccgatagcgataaagacaagctgagcaggccatactttttccgttccaggcagctcgcggaactcgtattttccatgctcatttttcactttttccatttggatagtatgaagctctttcagctttccgtttttatccgcaaccatttttgtcgtttgaatggagtattctctcggatctcttccgaattttgcttctgcttcctcgtatgcatattcaagcgtaaagacgtgtggctgttcaggccacatattgtcattcgtgcgggctggcggaagtttcgggtgtttgccgaattggtgcacgcttttggctttttgacgcagagcagtagccacacagtcagctcctgtatctccgcctccgattacgatgacatccttccctttggcatcaatgaattgcttgtctttaaaattagaatctaaatagctttttgttgcaagtgtcaggtagtccatcgcgtaatggactccttttgagtcgcgtccttcaattaagaggtcccgctgtttttgagcgcctgtgcataggatcacagcatcaaattgctcctttagctcatcagctgtaatgtcaacaccgatttctgtgttcgtgacaaaatcaattccttcttgcgtcagcaatttaattcggcgttctacaatgcccttctcaagcttcatgtttggaatgccgtatgttaaaaggccgcccgctctgtctgagcgctcaaaaacagtgacggaatgtcccgcttgattcagctggtcagcactcgccagtccggctgggcccgacccgacgatagccacttttttgcctgttcgtttttttggaattctaggttgaatccaaccgttctcaaatcctttatcgataatggtccgctcgatgtttttaattgatacggccggatctgaaatcgctaaagtgcatgatccttcacaaggagcgggacatacccgccctgtgaattcaggaaagttgtttgttttcaacagacgttccaatgcttccttccatctgccccggtagacaagatcattccattcaggaattaagttgtaaatcggacagccggatgtaaatccgttaatgtccgcaccgatctggcaaaacggtgtaccgcaatccatgcaccgcgccccttgccgtttcgatgcttcttctgaaaaaggagcagaatattctttccaatcctttaagcgagtgagagggtcccgctccgcaggtttttctcttttgatctccataaatccagttggtttccccatgttcctctccccttccttactgtactaccgcttgtttttgtcccgaagctgctgtattctgctttggcttcgtgttggcctcaaaagcgaacatgatagcttcttcatctgataaacctgcagctttttgctcttcgatgcttgcgagcatttgtttatagtttttcggaatgactttgacgaattttttcacactgtcttcccattgatcaagcagatcttctgctttttggctgtttgtatacgcagtatgtctttcaagcattgctttgatttgctggatttctttctcatcctctaatgattcaaataaaatcatctcaaggttgcatttgcgtttaaacgccttgacatcttcggccagtacataagcgatgccgccggacatacctgccgcaaagtttttgcctacatcaccgagaacgacaacgctgccgccagtcatgtattcacagccgtggtcgccaataccttctacaactacgttcacaccgctgtttcgaacggcaaagcgttcaccagcacgtccgttaatatatgcttctccgcttgttgcaccgtaaaaagccacgttgccgataatgacattgtcatccgaagcagagttgaatccttctggtgacttgacgatgatttttccgccagaaagcccttttccgacgtaatcatttgagtctccgtccaaataaagcgtcatccctttaggaacgaaagctccaaagctttggccggctgatccggtaaagtgcagcttgattgtatcttcaggaagaccttcttctccgtaacgctttgagatttcactgccggttatcgttccggctacacgatttgtattattgatttcaatcgaaatatcagcttcttttccagattcgatggcttcttgtacagccgggagaattgttgtgatatcaagcgattgatcaattttatgattttgcggagattggaatgtccgcactccttcaggctgataaagaagtgtagacaaatcaagctggcctgctttccagtgccccttcgcccgttcacttacatgaagtacatcagtgcggccgatcatttcatcaaatgacttgaagcctaacgcagccatgtactcacgaacttcttcagcaatgaacatcatataattcacaatatgatcaggatctcccatgaactttttgcgaagctctggattttgtgtcgctacaccgacagggcatgtatccaaatggcaggcacgcatcatgacacagccgagtacaactaacggagctgttgcaaaaccaaattcttcggcgccgagcaaggcagccatcacaacgtcgcggcccgtcataagctttccatctgtttctaatacaacacggtcacgaagtccgttcagcattaatgtttgatgtgcttctgcaaggccaagctcccatggaagccctgtatgtttaatactggttttcggagaagcgcctgtacccccgtcgtacccgctgatcacaatgacatctgcagtcgctttggcaacacctgcagcaattgttcctacacctgcttttgacaccagctttacgctgattcttgcgtcacggttggcatttttcaaatcgtggatcagctgggctaaatcctcaatcgaataaatgtcatggtgtggcggaggtgagattaatccgacacctggcgttgacccgcggacatcggcaacccatggatataccttgttgccaggaagctgcccgccttcacccggcttagcaccttgagccattttaatctgcagctcgtcagcattgacgaggtaatggcttttgacaccaaaccgtccggatgcaatttgtttgatcgcacttcttctatcatcgccgttctcatctggaacaaagcgtttgggatcttctccgccttcaccgctgttgctttttcctccaagacggttcattgcgattgctaaagcttcgtgcgcttccttactcaaggacccgaatgacatcgcacccgttttaaaacgtttgacaatcgattcagcggattcaacctcctccaacttcaaaggcttgcggtttccgtcaaatgcgaacaagttccgcaaaaatccgatgcgttcttcatcagccgcttttgtatactgtttaaacagattgtaatcatttctgcggcacgcccattgcaaagtatgaatcgttttcggattaaacgcatgatgctctccgccatttctccattggaagtcacttcccggttcaagcgttttgctgtaatcatcctgatacgcttcccggtggcggcgctgtgcctcttctgcaattgtttgtaaatcgatgccgcctagctgtgatgcagtacctgtgaaatagcggtcgattacatcgcggctgattcctaccgcctcaaagatttgggcgcctctgtagctttgcacagttgaaattcccatcttggacatcacttttacgacgccctcagtaatgctttttccatatttgctgaccgcttcttcatagctgatatccaaacggccttcatcaatttcctgcttgtaggtcgcataagcgagataagggttaatcgcatctgcgccataaccgattaacgctgcaaagtgatgcacttcacgtgcttctcccgattccacaatgatgctgaccttcgtacgcagccctttgcggattaagtgctggtgcagtgcgcttactgccagaagcggcggaattggtgtcagtcgttcgttcatctttttgtctgataaaattaacaaacttacgccttggctgatggctttctctgcctgtgtgaacatgtcctttaatccgcgttcaagatcctctgaaaacagcacatcaattttttggctttttaaatcaggatgaacaatcgttttcaatgcgtaaaactgttcattggataaaacaggtgtatacagtttaatccggcgaacatttcgttcacttggatgaagaagatcgccttccgcaccgagccaagtcatcgttgaagtgacaagctgctcacgaatcgcgtcgattggcgggttcgttacttgtgcaaacagctgtttaaagtagttaaacagtgattgcgctcggtcagaaagtacagcaagcggagcgtcattccccattgaaccaaggggatctttgccttctttaataacaggaattagatacttttggatatcctcatatgtgtatccgaatgccttctggcgagtaagaagatcactaaattgttcttcttctcttgactccggatcaggatttacttgtacaagctcttcttcaagccatttttgatacggatactcagttgcaatttgtgttttgacttcctcatcggagataatacggccttcttccaggtcgattaaaagcattttcccaggctcaaggcggtttttatataaaacgttctcctgttcaacttcaataacgcctacttcagatgagaaaataatataatcatcttttgtgacataataacgggccggacggagaccgttccggtcaaggatcgccccgatttgtttaccgtcagtaaatgaaatggctgtcggtccgtcccaaggctccatcagggagctatggtactcgtagaacgcccttttttccttggacatatgcgtattttccgtccaaggctctggaatgagcatcattgccgtatgtgccggtttgcgtccagccatcacaaaaaactcaaatgcattatccaaaatggaagagtcactgccatcagcattgagaatcggcaaaatcttgtttaagtcctcaccgaagctttcagaaacaaattgctgctcacgtgctctcatccagttaatatttccgcgaagggtgttaatttcaccgttgtgaaccaaatagcggttaggatgcgctctttcccatgtagggaatgtattggtactgaagcgtgaatgaacaagcgcaaaagcagaaacgaatgcttcgtcttgcagatcagaataaaatgcatcaacctgttcaggtgttaaaaggcctttgtaaacaatggtctggcttgaaagactggcaaaataaaaatcaagaccttccgttactccccaattttcagcctgtttacgaatgacatacaattttcgttcaaaagataaattgtcctttagatcagaatttgcgccgataaatacctgacggacaaacggacagcttttttgcgccactgttccgatttttccgacatttacaggtacagttctccatccaagaacgacttggccttcttgttcaatcagtgcattgatttgcttttcaattttttttctttcatcttctttctgagagaaaaagaccattcctaccccgtaacgttctttttctggcagattgatgtctttgcactcttttctaaagaaagcatcagggatttgaaccagtaagccggctccgtctcctgtatccggatcactgccttgccctcctctatggtctagctggcaaagcatcttaagtccttgtttgacaatgtcgtgagtctgcttgccctttaagtgtgcatataggccgattccgcatgcatcatgttcaaattcaggacggtagagaccttgagcttttggcatttgattgtacgtcataattcctctcccccgatcaatttccgataataccggtcataaaatctaacaactctataatcattgtaggttttcaaaacgatataaacaatatataatttagatcaaaagaatctcaaaatgagatagatggatgtgagacaaacatggagctgcgccaactgcgttattttatggaggtggctgaaagagaacacgtttcagaagccgctgatcatttgcatgtggcccaatcagcaatcagcagacaaattgccaatcttgaagaagaattaaatgtgaccttatttgagcgtgaagggagaaatatcaaactcacgccaatcggaaaagaatttttgattcatgtgaaaacggcgatgaaagccattgattatgcgaaagagcaaattgatgagtatcttgacccgcatcgcggaacggtaaagatcggctttcctacaagcctcgccagccagcttttgccgactgtcatttcagcgtttaaagaagaatatccgcacgtcgaatttttgctgcgccaaggctcctataagtttctgattgaagctgtcagaaaccgcgatattgatctggccttattaggaccggtgccgacgaatttctctgacataacgggaaaaatattatttactgaaaaaatttacgcgcttgttccattaaatcatccgcttgctaaacaaaaaacggttcatttaatcgatttgcgcaacgaccaatttgtattgttcccggaaggatttgtacttagagagatggcaatcgatacttgcaaacaagcaggctttgctcctctcgtttccacggagggtgaggatttggatgcgatcaaagggttagtgtccgcaggaatgggcgttacccttctgcctgaaagtacttttgctgaaacaacacctcgttttactgtgaaaattccaattgagttccctcaagtaaaacggactgtcggaatcattaaaccgaaaaatagagagcttgcgccttccgcgaatgatttttatgagtttgtcattcaatttttctctaagctggagcagtatcaataaaaaaatgaacccgagcttctatatagaagcttcgggtttttttctgcaaattaatttacaggtaaagaaaaatccacatggcaaacaaatgcttcttgatcaattagagctctatttgtcagttcctttttcttttccggttcttgaagctgtacagaagagtaattgacgattccaaggccgatttccgtcccttttgaatccatcagccgaacaactgaaccgcttttgaatttccctttaatcttctgtacaccgtctaagtataaactcgattggccgtttgttatttttcgtgaacaatcatctgataaaatcatttcaccttccggaccggaattaaaagcgatccattgctccttttgattcaacggaagcgttccttctgcttcaaaataggtgccttccgcctgttcatgaacggcgtggtataaaatatcgccggcatctgcctgacctaggaaacctttaatgccagacgccattacgattttaaacgcatcaagcttagaacgcatgccgccggtgccaacgatgcttccagtgtcacctgcgcatgcttcgatgtcaggtgttatttcacttacccgctgtatccttttcgcttctggatttgtgcgcggattgccgtcatataatccgtctatatctgataaaatcacaagcatatctgcatcaatcaaacctgcgacttttgccgcgagcgtatcattgtcgccaaacttgagccgattgacagtaactgtgtcattctcgtttatgatcgggataatgccgcgctcgagcagtacattcattgtattcctgacattgttgtatcgatattcatcagaaaaatcgcttctcgtaattaaaatttgggatgcgacatagccgtgtgccaagaacagctttgaataagcctccatcagcaatccctggccgattgaagctgatgcttgtttttctggaagcttctcgggcctttggataaatccgagcttccgatatcctgccgccactgcgcctgaggaaaccaaaatcacttcataaccggcgtctttgagtttgacgacctggtcgaccaacgcttctaattttcgaatgctgatttctccgtgaaggcttgttaatgaactgcttccaatcttcacaacgactcttttcatgcttgtatcaggcgtcactttatcactcctgatagcggcgctgcagttttttcgatatcttcgctgatttcctttgaacgcttagccgcatgctttatcgcttgagaaatcgcttctccgccgccgctttttttcaaggcttgcagccccgctgctgtcgttccgttcggtgacgtgatattatctcttaagatctcaggatgttctcctgtttccatgagcatttttgcggcacctaaaagtgtctgtgcgccgatgcttcgagataactgtttatcgaggcccgcttcctcgcctgtcttttcaatgaattccattaaataataaaaatacgcggggccgctgcctgcaattccggtgaatatatccatttgattttcttggattgtatagacttcgcccatgcatccgagcaatgcttcggccagcttcttcaagtcttccgacacatatttgccaagggcaatagctgttgcagaagcgccaatcatactggaagtgttgggcatcactctgacaacaggctgttcattaagcaatgattgttcaataaaagaggtggttatgccggcaaggaccgacaatattaattgatggggttgaatacgtgattttagtgatgacagagcgttttcggcgtcttttggcttcattgccaaaatgagtacatccatgtcttcaatacatagctggttcggcaaggcgcctttgattccatattgaagttcaagttcagttaatcgctctgtattgctgcggtttgtaacgcagatgttttgtttcgggattttgttggcacgaacgatacctgatatcattccttccgccatagatcctgctcctataaaggctactttcttttgatcaaagatcggtaacatctcctttgttcgcttttttgttcgcattttcacacgtttaaaatgttaccacgtgaggaaatgatgtcaagtttgaaggtcatcattgatttgtattgtttcttttcgacaaatatgtataatgaaaagcagaaaacacccggttcacactgctgcgccgggtgtttgtttctattaaaaattatctgagagagctttttcaatcagttttttacagcgatccagctctaccttcagctgttttttatatagcttggcggcttcgtaatctttaaattgatagaggacgacttcctggagcttagccccttctttttttactttaatttgttttagtatcccgtcatcaagaagctcatgcaaagaccggtatacttctgtatgatttggtttaaaaccaatctctttaaattcagaccgaagtacttcaagcagctttaacccatagagtctctcttgctctgtcatcgttatcatataaagcttcaaaaatgcgcgctgtttcactaaaaagcctgttgaactccttttttcttctttcatcatatgcactccttcttctgtcactgacaacactatgtactaaatattcaattttcttttattgttttccttctttatattaaagactgatagtccagtcatttcatgtttactgattataggtgtagcggaaaaaataaatttcgactgaacatttggtacatagttttcttagttctattatagcctgcattcactgctatcttcaatttaaacgattgccagggtttacatatctcattttaccggtacggatttcattcaaataaaaaaacctgtcgaaagacaggttttcatttttaaggatttgttgaccataatcccgctgttttgatgaaaatacgaggatctaatttcaattgtgccaccatgtactcagcaagatcctcaggctgcataactttttcaggattaccgtctgttaagttcaattcgatagacatatcactagcgacagtgctcggcgttaacgcgctgactctgatattatgttttctcacttcttgcataagagactctgttaacccgagaacggcaaatttagaagcgctgtaagcacttgttacagcagctcctctttgacccgctgtagacgaaatattaatgatgtctccggctttgcgttcgatcatttccggaagcaccgcgcgcgtgacatggtacacacccattaggttgacttgaataatattttcccactcatcggctgacagatctaagaaaccgccaaatttgctgatgccggcattattaatgagaatatcgatatcaccgagctgttccttcacttgagctacagcttggttaacctgatcggcatcttttacatctgcagcagcaaatgcagcttttacaccaagcgctttgacttcttcagccactttttctacattagcggaagtccggccaattaacccgatattcacgccttctttggcaagcgccaaagcagtagcgcggccaattcctctgcctccgcctgtgattagtgcagttttatgttgtaaattttgcaattgaagcaccctttctttgtttacatatgtacgatatcacattataagtacaatacatccaatacgcaaatcaaacgaactgtgtaaatatcatttcttctgattaaaaaaacggatacagggtaatgacataagaaaaggagtgaacatatgattatagtttatatcagtcttgcagtattagcagtttctattatcttcttaggagttaccgtgattcaaaacaagaaaaaaatggaccctgcactaaaggagctttcctctgttacgcaggctatgcaaaaacaaatcgaaggattaaaaacagaaacagagctgctgacgcaaaaacaaaagaagattcagcaggatgtccaaatgaaaaaatccgcgtttcagcagaccgcagctgaagtaaaagaagttcctaaagccgttaaagaggtgtggcaggctggccatttaaatagcaggtcatgatgaatgatatcccgttgtttcgatcagaatggacaatgggatatcattttttgaggaggctttcgcatgattgtaaaccgcagctgcttaaaggagttcgcagaaaaactacattctcttccctcttcacttacaaagtcggatttacttatttctccatttcatctccatcaagaaaatgaacttgacatctactattcacctcataatgaatatatcaatcggactgctacgattgtgattgccgggatcacgccgggtttttcccagatgaaaacagcgtacgaaacagccgtcgaaagtctgcggcaaggccgcactcttaagcaaatggcggtagatacaaaaatagcagcgggtttctccgggtcgatgagacataaccttatcaccatgctggatttatgcgggctgccgcaagctttcggcattcaaagcgccgcaaagctttttggagaattacggcatatgctccatacaacttccgttattaaatatcctgtctttatccagcaaaaaaactataccggatacaaaccggctatcactcattctcctatcctaagcacttatgcttttggacacttccctgcggagcttaaccatgtgacgggaccagctcttctcattccgttaggaaaagcggccgaaacagtatgtgaaacattgatcagacagcacagcctccagaatttgatttgccttaacggctttccccatccatcaggcgcgaacggccatcgtttgaaacaattcagcaaaaacaaagagcaactagaaacacaaattcgttcctttgctgcattggttgatttcgctatagaaaagaggaaataaaagggatatgataaacaaaaacacaaacgtggggagtggttgaatgtttcctatattagaaacggatcggcttatacttaggcaaatcacagatcaggatgcggaagccatttttgcttgtttctcaaacgatgaggtgacacgctattatgggcttgaaaacatggaatctataaaacaggccatttcaatgattcaaacgtttgctgccctctatcaagaaaaacgcggtatacggtggggaattgaaagacgggacacgaaagaactgatcggaacaattggctttcacgctctggcccaaaagcataggcgcgcggaaatcggttatgaaatcatcccggagcattggcgaaacggatttgcatcagaagtgctttcaaaggtcgtatcttacggattttctgcccttggactgacgcgtattggcgcagttgtatttaccgctaatgaagcatcaaatcgtctgcttctaaaaatggggtatcaaaaagaaggtgttttaagacagtacatgtatcaaaatggtactccatatgatacaaatgtgtactctattgtaaaaccaagagaatgacggcattctcttggtctgtgcgcacatcccctttcctttaaaaagataaaaaacgccctcaaacagggcgctttctaattaagatgcatattgaggagatgattcctccttaactgctttttcctcaggtatatgaatacatttcgtcaagaccgcacttgcaaggtaaaggaccgcaaagatccagacgacgccttgcgcgccgacgagaccgatgaacagccaagcgagtgcagggccgacaaacgctgataaacctgcagccaaattcaatacagacatggctgcccctttatcttttcctgccaccgtcggcacaattgcaccaatcggcacatagcctgccagcaaaccgccccaaataaagccgatcacgctgacaaccgctaagcttccgccggagaaaacaggtgcgtagtataataagagggtgaaaatgccgcagccgactccgccgaaccaaataacagtatttttccagccgaatttatcgccgacaataccaaagataaggttaaacacaatgttccccagaaaaatcgttccccaaatttgcagccacacattggttgagattccatgctgggccatgtgcatcggcaaaaagactggaaaaccatatgtaccaatgctgttgatgattctgatgattccgcctgtaagcacgcgcggatttgtaaataaaatcgtaaccccttttaaaagctcctcggctgtttctgatctttttcttttcttcttttcaaaacggtctttattgataaacaatgcaaagaatgcaccgagacatacccagaaaatagagctccaaagcgtattcaaataaccgaacgctttgatcgcgtagcttgagtaccaagcgccgaacacaaacatgccgaggcaatatgcaatccaaaaccagccgacagcagtgctcagtttgctttgcggtgttctgtaaatgacccatgtcaagaaagaataagcaaaaagcgggtaacctaacccttttacgaagtaagtcacatacatcactggcaggttcagctgttcaaatccaaatacgataaaagcagctgtaccgatcacataaaacaacagccccataaacatcgttcgttttgcgccaaatgcttcgagacatacacccgaaaaccaggaagctatggcaagcgcaattccgtatatactaaaaatagaagcggactgctgaacggtgagcccgttttcgatcaaaaaaggactgagccagccttgttcaaggccatctcccatcataaacaaaacaacccctaaaaatccccaggcaagccgcttcggtattcctattttatccaacatgtctgtctcctccttagatgctcatatcaatcaattaccgtattaccttattaaagttgaaaattaaatgattcctcaaaacagcagaaatgccgccttaaattaatactttgctttctgaacctgaaaaaaagcgctgtgtttgcttccatttctcatataaagccaattctgtctgacagtccttcggttcaatcacctggacatttgctgacatctcctccgttaattgaaaggtttcattgcaaatgactgcagcaccaacgacagatgcctgatgatatccctcttggacatagacctttttttgaagaagatccgcgatatattgagtgagcactttgctttggaatccccctccgcacacccaaacatagtcacgttcaaacggagtaacctctgttaaaatgtcaaagttccatttgattgaaaatgcgatttcttctagcgctgcacgtacaaaatgtgccctctttaaatgtgctgacagcggggcatcaaaaagaaaaccgcctctcgttaatgcattcttttcagccgataaataagagccgagagccgctacacatgcatggtcttcttttgcaagtgcagaaatctcctcctccatgacgtcgtacgtttcattcggataaaaaatctgttttaatttttgataattcaagccggtaattcccggattcgtttccacaagccaatgcccttgatctgtatgacagttcagccaggctttatgttttgtgtcgccatgatccgcactaattttggttattggcgttgttgtccctgatacaatgacaatgtcctcaagtccagctccggtgcttttgacagccagctgtgtatccccgccccctgctataaccttagcatttattgaaaggcctaattcggatgcatattcatttgctatcgttccaattgctgttcccgctcttacaagaggcggaaggatagatggagaaaagccgaaaatgtcgcacatctcttctgaccaagtgttttgcttcacatcaaatagcagggtttctgttgcctgtgatggttcatatgttaatattccgctcagttggtacgtcacccaatcactgatgcttgtaaagcttgcagtcttttcccataaagagggctggcgctgttttaatccataaagcttgagcgcagaaaaaagtgcggttggcaggcggcctgtgcggctgtatatctcttcccgatcgggaatgcccgcctcccactctcggccgcgattatcgatgttcggcagcccgagaaaaggattgccgttttgatcaatcaaaacaatcccctgtctttggctcgtcgatgtcaaaccaatgatgtcaatatcacgcgaacgggatagcgcacgttttgccaaatccatcacctgcttccacagcacctgaggagaaaaataacggctgtccgggtaaagcgtctctgtggaatactcgatgtcctcccgttcaactgttagaacactgccagttacactcacgaccgctaccctcgcattgcctgtgccaatatcaaaaacgagatagcctttttgttttttcattctcttagcctcctttcttatacccctgttttcagtgcgtccttgttatacattgtcggaatattaagagttttttcacccttccactttttgagggcgttattcagtatcgtcacgtgatgatcctccacttcaaatgttgctccagcgagatgcggtgttgccagaacattaggcaatgaaatcaattcataatctgattcctctggaggttcatgataaaaaacgtctaatatcgcacctctgactttatgttcttttaatacagataaaagatcttcacggtttacaacaactgctcttgaagtattgacgaaaatcgcactctgtttcatcagatcaaaatacttccgatcaataagtccaagtgtttcctcagtacgaggcagatgtacagaaacgatatcactgtctgaaaacaccgttttaagagatactttttcatacagcggatgatcgtcttgaatgtatggatcgtaatactttattttacagtcaaacgcagtcagcagttttgcaatcctttggccaaccgccccgaacccaatcatgccaaccgtttttcctgataattcatttcctttaaatttgacataagcctgtaggtaatccctgtcccactttccatccttcagccattgattcgagacgctggtatggcggagaaaggtaatcacatttccaataaacatttcagcaacggcttgtgcattccgccctggtgtataaaaaacaggtatgcctctttttgaggcagctgccacatccacattggagggcattcccctgcaaacaccgacaaatgaaagttcgggaacagaagcaaatacgctgcctgttacctgatcaagctcagtaatcaagcctgtcgcatttgttgcttttagcagctgaatgagttcatcttcccgatatgcccggccttgttccttccaagattgataagcaactgagccaaacaagttttctagctcttttcgtccttcttcgttgtacggtgctgtaaccaaaaccgtcatggtgcaaaacatccttttcatcgtatttttcataaaaaaaatctctttccgaagatggaaagagattcatatataggcgcgctctgttacaggcagacgccggtataaaccttgctttcctatctttcaagctgacgcttgctggaattggcacaataatgttgccgaggtttcatagggccagtccctccacctctctggatagaaaatgttgagtatgtaattttcagaataaagaatacgtttatcataaagaagtctcagattgatgtcaatctcttttttcagaattgacgttatgatccgaaatgttataattcttacaaaatatctaactagagagaggaactgggccatgaaatcttttgccacacaacaaaacggcattttcaaatccgtttgctcgctggactgcccggatcagtgcggattgttaatacataaaaaagacgggaagatcgtaaaagtgcaaggagaccctgatcatcctgtcacagccggaaacatatgcaacaaagtccggaatatgacggagcgcatatatgatgaaaagcggctgactacaccgctcaaacgaacaggtgctaaaggccaagcgatatttgaaccgatttcttgggaagaggcaatcgatacgatcacctcccgctggaaacagctgattgatgaagagggagctgaaagcatacttccttacagcttttacggaaatatggggaaattgacagctgaaggaatggaccgccgctttttttaccgcatggggtcaagccagcttgaacggacgatttgcagcaaagcgggatctgaaggctataaatatacaatgggcataagcgcgggaatcgatcctgaggaaaccattcatacaaaactatttattttttggggaatcaacgcggtcagcacaaatatgcaccaaattacgattgcccaaaaagcgcgaaaacaaggtgccaaaattgtcgtgatcgatgtgcataaaaatcaaacaggacgtctcgcagattggtttattccgataaagccgggaaccgacagtgcacttgctcttggcatcatgcacattttatttaaagaaaaccttcatgatgaagcatttctgtctgagtacacgattggctatgaagagctccgtgaacacgtgaaacaatatgatcctgaaaaggtatcgacgatcaccggtatcagtaccgaagatatttaccgactggcaaaaatgtacggggaaacctccccttcttttatcagaatcggaaacggaccccagcatcacgataacggcgggatgattgtaaggacgattgcctgtcttccggcgatcaccggccaatggctgcacacagggggcggcgcaattaagcataacagcggaattttagaatataacacaaatgccttgcagcggcccgacttattgaaagggcgcaccccgaggtcgtttaatatgaatcagcttggcaaggtgcttttggaaacagacccgccgattcgctctctatttatttacggaacgaaccctgccgtcgtcgcacccgaagcaaacaaagtcagacagggcttgctgcgggaagacttgtttactgtggttcatgatttgtttttaacggaaacggcggcatatgcggacattgtactgcctgcaacatccgcttttgaaaatactgatttttacacctcctactggcaccattacattcagcttcagcagccggtgattgagagatatggggaaagcaagtctaacactgaggttttccgattactggctgaagccatgggattcacagaccaggagcttaaagattcagatgaagtattaatccgccaggcgcttgaccatccagataatccgcatttggcagagattgattacgatgcactcactaagcattcatttatgaaagcaaaacgcgaaaagccgctgtttccgggcgaacttccaacgccaagcggaaaaatagaattatattcagaaaaaatgaaacaagacggcttccctgctttaccgacatatacacctcttgtaaccgataatgaacatccgtttatgtatgttccggggccaaaccataatttcttaaactcaacattttccaataatgaaaaacacatcaagcttgaaaagacgccaaagctctttatcaacacaaaagatgctgaagaacacggaatcgttgatggggcacctgtacgaatttggaacagccgaggagaatgccagctgaccgctgcagttggagaacaagtgctgccaggtgtcgttgtcagccaaggattatgggcggatgaacaaggaaaaaaacagcttgtaaacgcgctaaccccagaccgattgtccgatatgggcggcggcgccacctttttttcaggccgtgtacagattgaaaaggtttgaaaaataatgaaacccggagtatgccaagcccgtataacataacattgacataatggaggcatacacatggacgtttttttaggaattggtattgctttggcaggatattttatcggtgaaggcttaaagcagatgaaccatacaaaaggtagtgaacaaaatgatatcttgcttataaaagaacgggatatttacttttacatcggactttttttaggaataacaacgactgaagcaaaacagttagctggagacatggcagacctgccttacattgaaataaacggaaaaaaatatgtccagaaacatatgttaaaagattggacattcacattagttgaaaaacatcagggtgaataaaacaaatctgaggagagcgagattcattgtcacgctctcctctgtttagctgtatggattgaccgccaccaaaactttgttcgataagcgctgataaaacgataaaccaccatctatgttctttcctcaaacagctcgagatgcccgttccacaacaatagtttgtatattccattgatgacgtgatgatcttgatgaacgtatgtatcgtaaaacacttagaaaacctattcggtttgaatgtgtgctctcattatgtccccatactgcgcctttatccgcggagggtttttaaaaaaatatgaaacctaaagcttttagattcaggcagcaatgttagtgcaataccctttatttttattgacctccatatatctccgattggtaaaactacgttagcctgatttgctttatacgccggaagctgttcgtttataaaggatcagagaatcccataaccagtaaatcactgcagccgcaatacttaacatataataaaaatacgattgcaatgtccatgctattgacgcaggttcattgataacaaaaaacaagaaagctgcgataaaagcaaccacactgtaaatcaataggtacatgacattgaatgttctcgcttttttctgcaacttcatttggagcggaacagcaaaaaggccatacaccacaaaaccgtataataaagcaattgcagccgtaaacaatgcaattatcatatcgccatacataacaaaagaataaaatcctaaaaacaaaccaaatgtaaggctggatagccctaatgtcattaaataatatgatgcaatttttttcattttttcacccccttgtttgatttattcacagtgctgttagtataaattcacaacctttgtatttcttttatcgagatgtcttccccaacgtgctatacgcaatgcgctgataaaaggtttcaaaaatgacgttcttttattagataatacgctggcatgaaaacgcctctcctgattggcgaaagcgcgaatgaaaaaagtgaatgaatacctgatcaacagacaaaataagaagagttgatattcaacacttttcgtaaaggagtgaaaccaatgagtaaaaagggaattcaaaattcaagtattgaacaaatgagaaatgaccatgagactgaaacagcttttaaagcagatgatcccaaaaaacatggttctgatcctaaaagaacgaaataagttcttacccccactaaaatatcaataatctggaggaagtaaagtgactcaaaaaaacggtgcagacagacctgatgattataaaagattttcttcattagacaaggaatatgattttcagcaatctataagcagcaatactaagacagaaagtgtaaacactgaaacacaaactcataacaaagaaaacaaaaatgacacaacagatgttgccgggaaatactttgagccctcagattataaaggaagcacgcaattagaaaaaggattagctgaaactcatgaacaggtcagtgatgactattttgaagggacgatcgatcaaaatttggactagccatacaaacagagctaacttaaaaggtcagttagctctgtttttagaaacaaccacagtaaaagagccaacccccaccgaataggatgggggttgcacgtaagtagcctgtttaatatttaaaacgattaatgactttttgaagttcttctgccaactgagatagagattctgcggcataggagatttcccccattgaatgaagctgttcctgtgatgaatttgcaaccgcttctgtattagcagacgtttcttttgttccagcggccaatgtatgaactgtgtgctgaatcacttcaacgcctgatgtaagctgttgagttgccgctgcgacttcttgtatttgagaagtgacctgttccacaaggttcagtatttcattgaaatttcctgttgcctcttgagaaagaacaatacctgagctcacattttcttgaacaaccttaatattgtttaccgtttctatcgattcattttggatggtcgctaccaccgattggatgtggtttgcagatttatttgtttcatccgccaacttccgaacttcttctgccaccacagcaaatccttttccttgctctccggctctggccgcctcgatcgctgcatttagtgccaacaaatttgtctgctctgaaatcgtcgtgataagcgaagagatatcgctgatttctgctgtgctcgctaccaatgtttgcaatccattgccggctgaatctacagatttatcaatgaatttcatctgatctaacatcttgttgacggacttagagcctatttcagccttgtctctcatcgaagaagaaagatccgctatgttccctgtatttgaagcgactgatgatatactgtctaataattcagtgatggattctgcgctcttttctgtcattgagctttgcttcacattgctgtcggcagccatctgcatggctcgggaaatatgttcagatgttgatttcgattcttccgcgcttgccgataattcttcggaggaagcggcgacttgttcagatgagctgctgatctgcttcacaatttgagttaatgaatgagtaaaagaattaaacgattgggcaagctggccaaattcatctttatttttcacaatgacttttttggttaaatcagcgtcgccgtgtgcaatttcatccagctgcttatttatgcttcttaggggcaccattatagactttaacagcattatgcttaaaacaacgcctaatataactgatatcccggtgacaatgatgatgagccattgactcattttcccattgccctgtatttcatcctttagatcctctacctcttgatccaggcgatcagacagcttattgacagccggatctacgacttcttttcttaatgttctttcttctccaaaatggatggtttctgcttttttaggatttgaagagtaggctgttactacctgctgattcaaagctctatactgagtaaaacttgtcttaatgtcttcaatattggattgatacttctcttcatcaatcaagtcattaacccggtcaaggctctttaagacatcgtctgctttttccttcataccctcgtcgtattctttgtctcctccggtaatcaagaagcctctttcatcatttgataacccggtcaattcatattggatgtgttttatctctttttggaattccattttgtctttaagttcttcattctttttcacagtagaagaaatcataaatactgaggagcctccaattccaataattgaaacaactaatattgatataatccccagcaattttgttttcactttcatgtgtcgttttccctttccgcacaatgtaatggctgaaataaaatatgttcaagcgcgtttaaatccaattcgcttacgcccatgtccataatatcgacacgggttatcaagttttatagtgatattctcatatgaataagcaaattctttacgtctctgaacttacagaaaaacgtaagtcactcttttcgtttttctaaaaaaggcttttcccatctcaaattggctgaacaggctgttttctcgaaaatataatgacaatacgcagcatacatttaaggagcgatacactaaaatgggaatcatcaatggtaaagaattcattgaccgattgaataaactagaaaacgaaatatggtatgatggcgaaaaaataaagggtaacatttctgagcatcctgcatttaaaggaataatcaaaacaaaaagctcactttatgaattgcaaacaaaggatgagttaatacatgaaatgacttattgccttcctggagatcataatcgaatcggcctttcctatctccagcctaaaaccaaaaatgatttgaaaaaaagaaggaccatgattgaacattgggctagacatactcacggaatgatggggagaagtccggattacatgaatacggttatgatgagctttgcttcgtcagcggagcttctaaaagataaagagaattgctttcctgaacatatactagatatgtatgaacaagctgctaagcatgacctttcttttacccatacattcattactccgcaagtgaaccggtcacagtcctattttgggctaagtgaaaaaccgatatctgctaaagtcattgatagaaccgaaaaaggtttaatgattcatggcgcacgactgcttgcaacacaaggcgggttgaccgatgaaatcttggttttttcagcgcctaaatatttctttgaaacagatgaagcttatgctttttcaatcccttctaatacaaaaggcgtaaaattcatcacaagagaatcatttgtattaagcgactcttcctttaatcatcccttaagctcaaggtatgaagaaatggattcaattgtggtttttgatcatgtgttagtgccgtggaatcgtgtgtttttttacgataatgtggaagcagctaaagattttatgacaaaaagctcctttcatgcctttacctttcaccaggttgtcattaggcaaatgataaaaattgaatttctattaggtgttgcacagcttcttgtcgacaccattaatgtttccgaatatcagcacatccaagaaaagctctcagaaatcattgtgggattggaaacaatcaaagcgctcattgacaaatcagaaaatgatgctcagttagatgaattcggctatatgcgcccctgtttaattcctcttcaagtcatcagtacgatcattcctaagctatatcctcgatttactgaaatcatacaattaattggagctagcggaatggtgacactgcctaccgaaaatgcatttgactcagagatacgggaagatcttgaccaatatcttcaagcaaccaatacaaatgctgaagaacgtgtgaaaattttccgtttggcatgggatttaacaatgagttcattcggaactagacaaactcactacgaaagatattttttcggagatcctattcggatttcaagcaggctgtataccagttatccaaagcaggagcagttgaacatgattaaaacatttttacatgtagatgcagaacaatgaaaaaacagcgggaaaagatccgctgtttcgtattttttattcaggaaactgaacatggcccggtacagtataggctttggacgttccgctttcaggcagctttggaatggtgtctttcacaacttttccgcggatgtcagtcattctgactttgagagagcctgtccctaaattcgtactcacaaaatggttatagtccattttctccatgttgatccacttaccatccttttcatattccattttcataacaggatacttgtgatttctgacttggattgctgcccaccacctgctgctgccttctttgatccggtaggtgaaattgccggtgattggggctttgacaacacgccatttaatattgatttttccgtctttcatattgccgattttacggaaggcattaggtgacagatcaagagctccccgagcgccttcgggataaagatcagtaacatatacggttgttttcccttttggcccttcaacttccaaataagagccggcaagtgctgcttttactcctccgtaattgagatccgccggatttattgcagtaatctccatatcggaaggaatgggatccagcaggaaagctcctcctgaataacctgaccctgtatacgttgcataaccttcatgcaggtcgtcatatgctgccgaagcttgcggggaaaaacagaagatcgtcaacaaaaccataccaacaaatgcactcatgatctttttcatatttggtcctcctcaaaccagacttcaaatgagaatcattatcattataagactcaatccatctggtttgaaagaggaaatagattcatagatgattttaaggcaaattcactatcattcatatatcaaatgtaggtacttatgaaaaagccaatacaaatgaacgaatgtgcacttcagccgaatgtcttattttcccctctcaaaattcgcattacaataacgaaatgaaacaggctgttggcctgataacagctacacaggaaaagctatttttccccgctcagtttcaacttagctgtcatcataatgccaaatatcagcacaatcggaacccaaataatgaagtgataaaaatcaggctcagccagagcaacaataatagcccccacacaatacaaaataatagccagtgctcttaacacagtatctcttaagaaagtcttcttctgcatcttaaaaaacaatcggccggatatatcctctaaaagagaagccaaagtgccggtcaacacagttgaagaaatacctgcgatccccagtttttttgctgctgtagtttgaatccccatagaaatgctcatgagtataattagaatgtgcacaggaacaaaagcccggtaataagaaagacaagcaaagacaaacaaaatgaatgcttcaagtgcgagggcttttgtcacagcagaaggccaaagggtattttccgcctttccgaccatcaatgtggcaatgatcacgccgcatataaatccgattagcgcagtcaaggaattaaaaacagtgacctgaatggatttgccgatagctaaccccaataatacaatgtttccagtcatattagctgtgaacacatgtcccaggcttaaatacccgattacatccacgattccagctgttaaacataaaagtgatagcaaggtgtttcgataagctgctgcagtcaacggtgtatcaatcctttcttctattttaattgttagtatgtcttttggcgcaatctgtattttttaagtaacccaacattaattaggaagatagaacctatcattcctttccattaactgtaataataatccccgcaaggaaatgattaaaattgaaaggaagcatattgtgatgaaacgactttgtttatggttcaccgtctttagtttgtttttggttctcttgcctggaaaagcattaggtgcagccgattttccgaacacctcaacaaatggccttttaggttttgccggaaatgccaaaaatgaaaaaggcatttctaaaacgggcacaacgggtggaaaaaacgggcagattgtttacattcaaagcgtaaatgatttaaaaacccacctaggaggatccactccgaaaattttagtgcttcaaaatgatctttccgcatctgcgaaaacaacagttaccattggctcaaataaaacactcgtgggctcttacgcgaaaaaaacgctgaaaaatatttatttaacaacttcatcagcttctggaaatgtcatttttcaaaatttaacgtttgaacacagtccgcagattaacggaaataatgatatccagctttatttagattccggtatgaactattggattgatcacgtcacattctcaggtcatagctatagtgcaagcggaagtgatttggacaaactcctgtatatcggaaaatccgcagattatatcacgatcagcaactcaaaatttgcgaatcataaatacggtttgattttaggatacccggatgattctcagcatcaatatgacggctaccctcacatgacaatcgccaataattattttgagaacttgtatgttagaggcccaggtctgatgagatacggttactttcatgttaaaaacaattacagcaacaattttaaccaggcgattacaattgctacaaaagcaaaaatatattccgaatataattactttgggaaaggcagtgaaaaaggcggcatccttgacgacaagggcactggttatttcaaagacataggcagctatccatcactcaacaagcaaacctctccgctgacttcttggaaccccgggtcaaactatagctatcgtgtccaaacgccggaatatacaaaagaatttgtcacgaaatatgccggatcacaaagtacaactctggtatttggctactgatataaaagaggccctgcgttaaaaacgctgtgcctcattttatacttataggctatttttaagcgatccttgtaactccttcaagatccagcgtcggtcaaactaaaaagcatatgtttttttctacataacttcttaaatggctttcttattataccagtttatcgcaagtaaaaagacatcattgttctgaacctgtattaaatgaacgttcgtcccacaaactattcaaaaacccctaaaaaggatgatggatatgtgcggcaggtttactttgtactctgcatttgatgatattattgaccagtttgacatcgatcaattttttcctaaaggtgaataccagccaagctataatgtcgcaccatcacaaaacatccttgcaatcatcaatgatggatcaaataatcgcttaggcaagcttagatggggacttattccaccttgggcaaaagatgaaaagatcggttataaaatgatcaatgctcgagccgaaacaattaccgagaaaccggcctttcgaagaccgcttgtcagcaaacgctgcatcataccagcagacagtttttatgaatggaaacggcttgattccaaaaccaaaatcccaatgcggatcaaattgaaatcatctgctctttttgcgtttgctggcttatatgaaaagtggagcacacatcaaggagatcctctttatacctgcaccatcataacaactgagcctaatgagttcatgaaagatatacacgaccgaatgccggttatattggcccatgatcatgaaaaggagtggcttaaccccaaaaatacaagccctgattatctgcaaagtttgctgctgccttatgatgctgatgacatggaagcataccaggtttcatcattagtaaattcacccaaaaataattcagctgagcttcttgatgcagaaaatcatatgtagtgattgaaattctctagcaagaacttgtcaaatagctttgttccttaggtgccaatccctctagtaattatgaatatttagtacatagatcaattagttatttttagcatcagtttgaaataattttattatgtaaacttaaataagcaatgttatccctttcatataaaatagtttacatttttataaaatcgcttcacttttctattttgtcagcaaaaaaactgaaccacattaaacttatgaaacctgccgcacctgtgattgcaaatatgatataagcccatagaggtaaatccatacactttccctcctaagaattaaatgaaatttctttcatcttacatgaaggtcttctttcttttgtttatccagtgtaatacttaataatatgttgatgaatgcagctggaaaatatataaatcccactccaagaatgcctagtatcgtacttaaacttactatgtaattctttgtcatcgtttgactgtcaatcaatattagaagtgaaatcaatccagctaaaacacctataaaccaagcatcgccaacagcataagaatcatccagcatccctaaccatcgccccaatatagagctcccaatggcagtcaaactggataaaaatatgagtgctttcatttcttgtcctcctttaaagccaatcaaactggtagaaatcggccattgaatttccattagcgggtggttatcatttccacattaacattttaaagctcattacaatacgattcaagcagaaaaaccctacataacgtatatatagggatttgataaaacacaggccaacacccagctctagttactttaagaccactgtatgatcggttcagtctttacgtaccgggatatttcacaacaggcactttcttcttacgcagagaatcaagcatgactgatccagcattcaagttgctttgcactaattctttaggcgtcaatgccatccactgattgagtgacacatctgcatagcggtcacttttgaacatttctaaaaaccataatgtttctgtaccagtgttttgtatatagtgtccagcattagaaggcacgtatccaacgtcgcctgctctataatcaaatgtgcgggcagtcccatttccgataaataccgtcattcgtccctgtcctgttagataatattgccactcatcgctattgggatgccaatgaagctctctcatcgcgccaggctcaatctgaacaagtgcagcggctatcgtttttgaaattgggaagttagaagaatccacaattcgtacactcccccctggcatttgaattgggggttgatttaacaactcgtgtttaaaggtcatggggacttttccatatggtgactgaatgtcttcactggcgactgatcccggcacattcccttggtagatatagacttgctcagacggaagagagttgaaagcattctccgggacaccgaaatttgcagacagaacgtcttttggtgtgtgtgcaagccaatctgaaatggttaacgttgaaaactcagaaaagtttccatcatcgaatacgagcagaaactcgcagagttccaatccctgtatggaatgcggaattcctgctgggaagtaccaaaggtcgccgggaccaacatcagcaatgaaatttcgtccgtcttggtcaacagcggtgatacgtgcccgtcccaaaagcatataagcccactccgcttgcttatgccaatgaagctcgcggacgcctcccgcagttaagctcatgtttacacctgcaatcgcagtcgaaatcggaagctgtcttacggtgatttctcttgaccagccgccgtgatctaatttcataggagcatcagagaatgaaaatctcaagttaggaatcataccctcatctgtaacaggcggcacaagtatattcggattttgaatatcccgcattatatttcgcgggcctgcatcaatagctccagctccatcacttcgaataggctgtggcacgtttctgtcttcatgattgattggttgttgttccaacagcatgcacctcgttttagaaaatgaacaagattttatttcagcctatgcagaatcttagattgctgtgcctaggaatccgcaaataaaaaagtgaccacgaatgtgtcacaaatacatcaaataagctattttttataccatggcttcttatgtaatttgatttcttctgtctgttttttctggcctgtcctccactccactttcactaatacatcatgtcctatcacttcatcttcaggcatataatcaaaggtggcaatatggtcctccatgcgtcccccacccggcatttcatcacctgtgtactctgataagtcgtactcatctacgttatcatcttgatacttttcgccatcaacatacagagtaattctttcaacaacagtcctcttttcgtccttcttactcccctgccaatacagatttagaaaataattgggtccaattgaagttttgtctgatttttcaaggttagacatccacagtccgtttttcccgttgccctcatatttcactttgtttcctgacaccattgcaaataatgtggtgatacagatgatcaagaatccagcaatgatcaatagccatttcttaatattgttcttttttctcatgtttttccccactttcctaactcgttagtaggaaaatatgatcaaaatgttactgaaaagaaaataaaaaagaaacagatggctgtttaaacttttgacttaaattaaagcgctctctaaagacaagattaaaacttttaacagctcttaaatgcattttttgtttcattgagtcaataaccttaaaatgggctttttatttttataactgaattgactgaaattgaactctaaaaatttcgaaattagagttttttaataatgaacgggctgcacttgtttaggtgtcactgtcattatcagtaaacatattatgctgaaatacgcagtcagtcacaaagtctctattcgtattcaataaagactttgtgatcatcgacaaccatttcactcccatcggataatgtatccaaaaggcctcctctggttcttctctatagtcataaatcacagtcactttgacatttgactcagctatgattggttttccaacaattattttcgttttttcctcaggcaaagtaagagatcgaatcatcaaagccattccatctttactgtctaattaacgccatcttcagtgaatttaaaggtctgttttaaattgcgtccttcttgccccttctgtgtccaaataatcacaacctctaattcagaggccttatctgccagcataaaatgattgaacttcagcggtgagccatcatttaaactttcagctaacattttagaatcttcttttggtttgtcacaattttcatcgaggcatccaaaaagtgaaaatcttgtgattgaatcaggatcatttctatacaattgcacatccactgtagctgctttttcccctatatttttgacttccaaggaatatacttgatattctcctttttgaggtctcgcaaattcctttacattttttgcttcacttacttttactgaccactgttctgttttttgtgtaataggcaacaccgtaaaagtcagggcatgcgcttttgattggcaaaacgtaaacccaactgctgtaaaaacaattacagaaaataatacccttttcacttcatttatccctccttcctttcactggccgctccttaaagaattgattttgagcaatctacaagctctcttaaccaaaaccttacctgaggttttgtctttactgctctgcatttatttctttcggtatccgagatggagctttggggatttttctcaatttgctgtttatcacatcagaagagtatagcgtaataatcatacttcccccatacctttttgcccgaattaagattggttggttatattggttttgaaagcgaaagtcaggacctccccagcttaccgtcgcatcccgtccgggcggtacatatggtacacttctagtatgagaatagcgctgaacgatctgcagtcctgcacgatcgactgcattaaatagagttgaggacacctgacaaattcctcctcctacaccttcagacaactccccttttacaataatgggtgcacttttatatcctttgttccgagttctcattcccacaacttggttaaacgaaaacgtctcattagggaaaacaacgtgattgtcgattgcttttgcagaaagagaaatattgtgtgaacggcttttattgcttgagttaaaatacgtcacgtactgaccaagctgctgcgtactgatgtgagctagcagctcgctgtcaactttcggataaatgttcatttccggcacttctatcttggagggaccttggccataaaaatacgcataaaacttttccataaacgcctgttgatacagtttgtagccaaccctgcccgggacgatgcttccatgatcgttaaggacagcatttatcggctcacggtacactttctgatcaagctgtttgatgaatttactgtatttttcatagtcaaccattggagtgccgggaagaggcattgtaaagtcttcacggttaacagtggcaatcgtccgtccttgctgtgtgaccgttaaactgtcctgcggctcactcggctgagccaataaaaaaagaccagtgatcaaaatttgtatcataagtcggtttacctcccgatcattagtatgaacagccgcttatcctttgatgtatttcttcccatcgtttgtttgaatctttagacgttgataaaagccttcataaaagagcttagctttatgttcacaccgatccctgagctctaaggcacacggttcattcagtcgacaagtttgaagtagttcagcatctcccagtgatgagggatgcttttttgtcttgtcaaaaatgaaaagggtctcctataacaacaataaatcaatccatttcaatatttttttattgagaaacgataaattttttgttacattcaattagacaacaaataaatgaggtgcttgttatgaatcgaatgtcgacaatttttttaaagatagctttggttcttattggaattccaattcttgctttatgcatttttttagtgcctaagatagccaactattcagcggatatatttccaaatatcgcttatataaaatatctcgttttcatctatttgtatgtaacggcgatacctttttactttgctctttatcaagcgttcaaacttttaagctatattgacaaaaacaaagctttctcgggtttgtctgtaagagctttgaagaatataaaatactgcgcagtcactatcagtatcttttacgcagcaggcatgcctgtcttttatctgatggccgagatagacgacgccccgggtatcattgtgatcggattgattattatttttgcttcaatggtgattgcggtctttgctgctgttcttcaaaaactgttaaaagaagcgatagatataaaatcagaaaatgacttaacggtctgaggtgatgacatggcgattattatcaatattgatgtgatgctagctaagaggaaaatgagcgtaacagagctttcagagagagttggcatcaccatggctaatctttcgatattgaaaaacggaaaagcaaaagctattcgattatcaactttagaagcgatttgcaaggctttagaatgtcagcccggggatatattggaataccgaagtgatgaagacacacaggattcgtaaagaaaaaatatgtaggatcaacagaaaaataaagtgattggcggtgagcttatggacataaacttatatccatctagctgctatactaagcgtccctttcatacacgaagaacacaactatggaggaggcatgcatcatgagagcaataaaacaaatcgttcattttggctgggaacaagccctttcatgtttgtttcctgccgttatttttgcctctttggctattacgcaaatcatcccactgcccttcttgccgcggtatgactggctgctcattatctgcgttctcatgcaattgtggatggtgcgttccggtcttgaaacacgggatgaattaaaagtgatcacattattccaccttattgggcttgctctggaactttttaaagtccatatgggctcctggtcttacccagaagaaggatactccaaaatatttggagtacctttgtatagcggctttatgtacgcaagtgtagccagttatttgtgccaggcatggagaaggcttaaggttgaactggttaagtggccgcctttttttgcagttgttccgcttgccgcagtgatttatttgaattttttcacccaccatttttctatagacattcgatggtggttatctgggcttgtcatcattgtcttttggcaaacatgggttacatacgaggtgaatggagctcgttaccgtatgccgctcgcactttcttttgtactcatcggattttttatatggatagcggaaaatatcgctacgttttttggagcttggaaatatccaaaccaaatcgatacatggagtctcgtacaccttggaaaggtaagttcatggctcttgctagtgattgttagctttcttatagtagcatcattaaaacaagttaaggagcagaatcccacaaaggcagagattggtgaatctttttcttagcattcaagtcccaaatagagtgaaaagcaacgttcaaatggttgcttttttctactctgccgctgagtattcatcttcttcaaatttcatcgcaccacgataactgattcagattacaactgctttcaacaccttgacaaactcatgcgccgccggcgttatctcttcaattgaatgtgcgatgacgccaatatcgcgtgtgaccctaggaaagatgtcctttttaatcaattgatgcgggacggatgaaagtgtaaagtttgaaatgatgccgatacccaagttatttttgaccatattaatcaaggtttcggcattttgcacagttaagctttcctttaattcgatgttgtattgcgaaaatgcgtttgacatcgcgatttcatgaccgcctttacaaaaaattaggtcatcttgatatgtttcaaggtcgacatgcttttcaagttttaattcgtcacgctgcggcgggatgacggccaccatatagtcgttacacaatagctgattttcaaacggttcaaatggagatgctgcgatcccgatatcaaccgtccgatcctcaacccatccttttatttggtcagaggttccttcgatcaattctatgcggatcagcgggtagtttgatctgaatgccgcaatcgcctgtggcataatatttgttgaaactgcaggaaatgaaccaattttcaccttcccgtttaacagcttgttttcccggttggctacttgatatattttgctttcaattcccttcatttgcctcgccagcagcaaaatttcttttccgatgtcagtcagcattaaaccatgatgtttatccctgatcaataatttgagctgcagtgagctctccaggttttttatcgctttacttaccgccggctgagagatgaacaattcttttgccgcttctgtaatattcaatttctccccgacttttacaaatatgtgaagatggttcatgttcataaccatttggttatacccccaataataaaaatgtatttcagttatacataaatgtaacatatgatagaaaccagcacgatatttaaacaagaaaggcggcttcattatggtaaaagttatgctgggaatcatatctgtcacacttatttggggttatacttgggttgcgatgaaagtaggaattcatgacatccccccgcttttattttcgggtttgcgcctgttcatcggagcggttcctttatttctcattctcttcatccaaagaaaaaagctttcaattaaaaaagaacatctcaaaagctatatcatcatgagcctcttgatggggctgggctatatggggatcttgacgtatggaatgcagtttgtcgattcagggaaaacctctgttttggtatatacaatgcctatatttgttacggtgatcagccattttacattaaacgagaaaatgaatgtgtataaaacgatgggactggtctgcggcctcttcggactgttatttatatttggaaaggaaatgctcaatatcgataaaagcgctttatttggggagctgtgcgtccttgcggcagcgcttagctggggaatcgcgaatgtgttcagcaagctacaattcaagcatatcaatattattcacatgaatgcctggcaccttatgatgggagccgtcatgttattggtgttttcctttatatttgagccggtcccttcagccgagtggacatatcaagcggtgtggtcattgctgtttaatggcttgctttccaccggctttacctttgtcgtatggttttgggtgctcaatcaaatcgaagcgtcaaaagcatccatggcattaatgtttattcccttattagccctattctttggatggctgcaattgcacgaacagatcaccatcaacattatcctcggcgcactgctgatatgctgcgggatttttatgaaaacatttacattttcacgacggaaagtgtgaatgatatacatttcccctgtcatttgggcttcatgtgacaggagacgactattatgagaaagtcttctagaatcctgacgacagcctattaaacaatgaaaaaagctagtgtctgcatgtgagacattagcttggctggcgtttaggccggtgagaatctagattcttttttattaccattctggctgatcaaactgaaaaccgtatagaccttttactataacatctccgcaatctggatcttttgtcaaaatcaaataatgagtcttataaggcatcgtctcaactcgatcagttgcactcaaatcaaaatgatcccctgaaaagtttttttcactaacggttatttcatatcctgacaaagtcattcgcatgattcttgcattaattgtacatccttcagtatcgaaaatggtgaatctgtactcaaagtgagatgtccaatggtttgaatttaggtcatcagacttcataaaccatttttcattttctgtcattgtaaaactcactttctcctcatctttgacgataacggccgaagcttcccctacatggatagtcaaagccaaaagaaatgtaaaagctaacatcaacatctttttcaaaagagttcctcccgatatctttttacttcaatatattggaagggtcttttctgatcaagacagtcttctccaaatgaatctttagcaccatgaaatgagccttaataagaacagttttaacccaaatcaaactctattcgaattcttttttagagtttctgcatttctttatttagctcctagacacatataaaaaatgctcctataagttcaggagcattacaaaaaactgctaaagtgttttctatcgatttattgtattcattagctcaaagaagtattcaggcttttgagtcttatttagcttataccatgaacgcaatgtatctggtgcaaatacatctaattttttcaatacttctaccgcaaattccagaggagcaattcctgatgcagtaaccaaattttcatcagatactgcaggcccgttttcatataatgtttctcctttgtaattagggcagaccattttcatatactctaggtcattgcttgtgtgctttctcgaatctaagtatccttcattcgcgaggcccaaggttgcaccacaaattgcagcaatagtcgtgccaagctttaaagcgtcgtcaactttttttaagattggctgatgaatatcttctccccaagtgtttcctccgggtaaaatgataagatcttgactctcaagagtacactcatcaagagaaatatctggttttatgcttagtcctcccaacgtagttatcatttctttattagcccctactgtaactacttttaaagatgctgcatcctgtttaaaatatctccctgagtttagttcagcaattaaatatccatattcccagtctgacattgtgtgaaatacgtagagataaacttttctcgtttgcatccaataacactccaatcacaattgataaagccttctaatagatgacctcgctgacagccattttcagcttttttgttgtttcatatgtaatcgcctattcttatataataccatgtaggtgggcaattgccccttgttctcccaacttattaaaaatataagataaattgattctatgtttactagcgcaaaggggtttgttacactaactgtcatgggaaacatttcaaaggtaatacaaaatcatttgaatgaggaggcctgatgaagttgaaaaataaagcgtcaataaaattcggaatatgtgttgggcttttatgtttaagcattactggtttcacacctttttacagctcaacacatgccgaagcaaaatccatagaagacacaaacatggcaagctgtataacgaataaaaaatttgttcaactcgagaaaaaatttgatgccaggcttggtgtttatgccattgatacaggttcaaacaagacaatcgcctatcggccgaatgagcgatttgcttacgcatcaacctataaagttctagccgcagctgctgtcctgaagaaaaactcaattgaaaaacttaatgaagtcatccactacagcaaggacgatcttgttacatattctccaatcacagagaaacacctggatacaggcatgagcctaaaagaaatctcggaagcggctatccgttacagcgataataccgctgggaacatcttgttgcaacagcttggcggccctaaaggttttgaaaagtcactgaaacagattggggatcatgtaacgaaagctaaacgattcgagacggatctaaactctgcgattcctggtgatattcgtgacaccagcaccgcaaaagcactggcaaccgatcttaaagctttcactttagataacacgctcacgactgacaaacgcacgatcttaaccgattggatgcgaggcaatgctactggtgacgaactgattcgggcaggcgctccaataggatgggaagttggcgataaatccggagccggaagttacgggacacgaaacgacattgctatcgtttggccgcctaacagagctcctattgttttggcaattctgtcaaaccgctttacgaaagatgctaattatgataatgctcttatcgctgaggctgcaaaagtcgtccttaacgatctcaaataatatgtttagccttttgccacaaaggaaaagacattacttttttaacccctaccgttcattttttgatgaacggttctttcataggacctctagaatcatatatttaaacaccacaaaattaaacgttattataattaacggcaagttttcattttatggaacaagtaaagtttgacctgacaagaattaagattaagcaccctaaaatccgttttctttccttccaagaatatactccttagtgcaagctattataaagaagtgaacatacaatgcagacaactcccttaagtctcttattctgtgaccaatttgtaatactcataaatatccggactcacttccaatatttcgtctcgaagacactaacatatcaaaccacttgaattggtcttgttgactcagaggttatctatatgagaattcaacaatttttttataataattcatatttttgtatcgttgcacttggtggatttgactcttttaatgtatggaaccacacttttattttttcacctcttttgagatcatctgtgttatcaatctcacttaatcctacaattactatgttatttttaaacttgttcataagttgtccttcagaaagatcgtaatcttcttttactggagcttttgtatcggtaatgagaattgccctttcattgtctttaagcacgacatagcctactaggctctgcatctttgtttcttctccgtgttgttcatttttgcagcctgcaaggaaaataatgagcactatcaagcttactccgattttaggcaactttctccctcccgtcatgttaaacaatctcactccataactgcatatcaataaactgtagtgtaaatctatccagaaacttcttcattttctcatattgaatcttttacaagctgttaatacacagactaaatcgggtaaaaattcgtagaggtgatttctttgaatgatgatcataaagtaactcattactcttcatttattttttcaacaatcatggtatggcggtcgccacctttccacaatacacttcttggtttgtaacagttttcttcttgggttttgcacttatctatacatacgaaaaacataaaacaagttcttcaaaaacaatatcttatatcccgtattttttattcattgtttcattgacttacactttagttaatatgtaatagtaatcctccctttgtgggaggattatttgtttaagcttatttctaggctgcttttgggccacctctatctataatgataaaactatctgaaccatttttttcttccgatctttgtcttcgtaaatagcaacattttggcgtgtcattaatgtaataccggccattttaaactctttttgatctttaaaataaacaacagggacattcaccaaacggatctacttctttttgttctttctcaaatgtttgtatgtggttgtcttcgaaccatacccttactcttattccgctaaaatcgagatttttactttttatgatccattattcacttctaaaaaacttccaattacaacataatatatgtataaattgtaaatggagttgatataattgaagattaggaaaatcttattgagttctgctttatcctttggcatgctaatatccgcggttcccgcattggctgctggcacttcgtctgaggttgcagtaaaaaatgaagaatatgattacgatactatataccgcattagtcctctgccaatggacctccagccaacaatagaatacaacggttatacttatacgcttacacgtcattattttgattactcaatcgggttttacacggctatttatacaaaagttgtttaaacttataaaggagctttttagctcctttttctcttgttttaagcaaggtatttctttctatgtcgtcccctatcaaatacaatatcaacattctccagttctctttgacacgaacaaaatctaaagtttggttttaaatgctggtaataaaaaattcattttaaagaagtgccgcccgcaaaatgcggcttttgtacactacgccaattttatatagaaaagccagacctcctccaagaggttccagcttttcttaatgtgctatcgatcttcgttagttcaacggaactttatcattcggtacaattgcagcctcccgacttctagttagggctgatggggggatatctgatggctctctacacacatcagacattataagatttcaatgtagccttctgtaccgtgaacgcgaattcgttgcccatcttttatcagcttggcagcattttcaacgccaacaactgcaggtaagccatattcacgggctataacagctccatgggtcatcagacccccaacttcggtgactaggccttttatggatacaaacaatggtgtccagcttggatcggtaaaggaggtaactaatatatctccatcttctaaatcagcatcttccatgtttaaaatgacacgcgctcgcccctctataactccggaggaaacaggtagacctacaatcgctccggctgggagattttctcgtttatactcacctgtaacgatttcaccatcagacgtgataacacgtggtggagatagtttttcatataatgtgtactcgtcttttcgtgtactgatgatttgataatccagtttatgtgtgcgcacgacttcgtgaagttcttcaaaagtgagatagtatatatcttctttttcatgaataacgcccgcttctatgagttgttcggcttctttcagtaaagcctgcttataaacgaagtatcgattaaccatgccgtattttggatattccctaaacccgctgaaattccggatgatatctatcattcgttttgtttctttggctttttgttcaccatccggtaattgcttcaatcgatctaataactcttgttctttcttcaaagcttcctgtcgcccttgctcaaatttccgatggccgacattaggctcaaaatttttaatattattaagaatcattgggacaagtgtagttggtttttcgctccatcgagttcttgtgatatcaatttctccggtacatcgcattccgtatttgctgagataatcatagatcgcgtctcgggttttgcttccgccatcaaacttagccagttcatccaaaaaattatcatcttttacatgttgtaagtaatcaattacctctggataaggacgaatcacatctgcgacgtctaatagcgcaagacccatttctgaagtaatattatggggtacagattgagaaagcgtatctgctgcgttttttttcacctaaccacttgttcattttttcgttaatccataatgaagcattcatagcagttcgaatcacaaccgaactttcggggttaaataaaatcttctttaattcctggatatcttccagaataaaacgaaataaatctgatcctgatttcgtgtggatgttttgttttaactcttctatcgatatttgactgctcttaatcaaatcagacacgattgtcggatcgttttcaacttgagccggcatatctgcattgcctctgctgggatttggtgctgttttatcatttggtatcgactttatgaaatctcgtcgctttattatggtcataagtgcgtcttttaagagctgatcgtgctgccccatgccttttaagaaaacttctctgctgtcaggggatgccagatgatgtgtgacatcaacaaatagccttccaccggctttacgcatgggtgcagcagtcgtcaacagaaaaaaagacaatcccagtggttttatgggatccgtcatcatttgttgatgaccaacagaaatatagacgtgattttcttggtcactcgcttcagggatggggaataaagtagtgattggacgactctgtacaatataaaaagtatcgcgggccaaacaccattcgatatcttgaggctggccgaaatgagcttcgatctgtcttccaatgcgtgccagctgtaaaatttgttcattagtcagtgtttgagccttttgctgatcagaatcgatctgctgtgtttctgttccgccttcttttcgtccgtagatagccatttttttagttgctattctcttatcgatgatttgcccatcctgtactttataacaatcggcagataccaagccggaaaccagtgcttctccaagtccaaaaccggcatcgatggataacacctttcggcttgaggtaatcggatcagcggtaaataaaatccccgaagcctgagggaaaaccatcctttgaacgataacggataaatagacttggctgtggccaaatccattttgcatacggtaaataaccgcgcgatccgtaaatagggacgcccagcatttactgatatgctgcaagattgcatcgacgccgataatatttaaataggtgtcttgttgaccggcaaaagaagcatgtggtaaatcttcagcagttgcactagaacgcacggcataggcatgttcctcgccgaactgggagagatagtgagccactgctttcacaacatcggaaggaatgtctacttccataatgatttgccgaatcttccggctgatgttaccaatctgatctcggtcctcaacttttagcatcgccaactgatccaacaacacttgtaacgtttcgttttgttcgatggctttttgatatcctactgttgtgacacaaaatccttctggtacttgtataccttgaacttttgataattcccctaaatgtaacccttttcctccaacgagcgaaagctgtgttttttcaatttcatgtaaaccgagaaccaaagaactcattctacacctccccttcaaaaaataaatattgacaagagcttcccagcaggatataataaaattataagatgggtatctataactttttaaccaggaagcgcacgtagtatgattatatcaccgtgtctgtttttgtgcaatataaaaagaacctgggcaatttcaccaggttcttttcttaatttccgtaactagtcacattaaaaaacttggttcgagatgattcaatcctcttaggaaatcctaaagttgggttctttttggaactaacctgctttattcgtagatccccatttataaattagactttttgtttttaacagtcccacctttaactagtataaagttatgaggatctggttaactaccagatatttttattttgaaaaaggcttatgtttgataaagaagggttatgtaaaggtatctgttgggagcaagcgctgactacaaaaaattgatagcattctcatttaaataccattctattaacctatagggaaagttttaaaaccagatggagaataccctacctccagcaattccaaggccgttcacctagtagaaaacaacctttaaccattactaacgattttaataatcattgattataaaacttctcaaggaacgatcagcagcccgttagctacccctgattaaggatgatctgctaccacactgttacgttagaacttccactactttgatatccttctgtcgccatgacttggtaagcccaattactgcccagattcattccatggctcttccatgcgttaacatgattgctgaaagtgattgtagcgttgcttccggttggtctcttcgactggcgaacactccagtactgcgtaaaagtagtgcgatcgccatcaatggaaggtgcgttataacgtgtagttgtatatatgtcatatgtaccccatcactttttacagtacccttatacgttccagtaggtctataagtaccccatgaatccactacataatattctatgagcggtgatctcgtccaaccatataaagttaaatatccattgccattcggtgcccaaactccggcattatagtttatcgtcctaaatggcgaacctgtagtccaacctttaccaacaacaaaatttccggtattagaccaattaacactgtaattcccgccagacccattgacagcgtttactataccgcccccatcagtccaattttgccagtagtctgtgctagctgcagaggcggttgccgaaaacaagctaatactcattaaagctgccgataatccaactaagaaattctttttaaacttaaacatatgttacctcctataatatttttttccgactttgaggtagcactcgtatatatttaaaacattcttaattactaacgccaaagcttttgatcgtcctcttcagtataataacacgaattcacgagcgaatattaaaagtatttgtaatttaattacaaatacctagaaacacattataagtggtcttcttccaccatatcctgatccttttttcgcaggatcacaattcttgtttctaattcagatggagtaatatctgtaatgaattcccattgaatcttttcgtataaaggagatatatattagagattgtgaagtcattgttgctgccgcttgtctaatgaagggaagcaaatttatgaagaatatgaagaactgaagaagaaaacaattaaggttatactaagaaagaatcgctcaattagaattattgaccaaaaatttgaggatgatagcttaggtcagttttacaaagaagttgcaagattgttatttgaaagggctctgaaaaagaaaaataagaattgacaatcagggtaactgtggaatgtaaccgagcctccaattcaaaataaatttctttaaaatacttattttatttaaagagggactgtatatccctctttaaaattaagctttagattgctgctgaaagtaataaaaattgtacttttgatcaaacccttcttcgctaccacaaagaaaaataatgaattcaataaatgcgataatagaggggataccagtccagcaaaacaaaatatatagaataccttgtcctactcttcccaaataaaacttatgtattcccagacccccgaagaaaaatgctaataatgccgctacaattttgttcttcttgcttaccatgacttcctcctagttcattgctaccgtttttaaagtaacgctttcatattataatgcatttccaccagaaatcgtgaaaattttgaaattcttttgagatatttttattttattgagaaatgaaaactcatataattgaactagatggttttgggaggcgtttattcaaaatgtatggccaaagattacgtcaattacgaaaggcacacaaattaacaatggaacagttagctgagaaaattggaattgcaaaatcaagttacggcggggatgaagctgaaagcaaaaaaccaccattggacaagttggttattttagctagactatatgatgtttcagttgattacatacttgggttaacagatgatcctgatcctaaagtgaaaagaaagaatctaaaagagtttttagaaaaacccgatattcactgggatggatataaacttacccctgaaatattagatcctatacgaaaaattttgaagatggttactacaaacaacaattagtaaagtccgcataagggcttttgcataaaacaattattttattgaattttctggctcattttaagaagtttattcatgatgatagctaaactttcaccagctttttgtggcttctcacctgtttttatcagagtaattaaagcacttaaaaagtccactaagctattttgatttatttcaactgtttctttataagctttgtaagcttcctcaaactaatcaaattgcacacccttcatagcagcaacagcaaatttattgaaatatttccatatgactctgttaaactaaaaaatcttttgacattgattagtaagacaatgcactttaaataatcgtaccccagaccaatatgtaaattgcctgcagcaaaccaaaactgtgtacggttcaccattccttgcaactgtctcaatccctttgtataagtataataaaaagacaaatgaatttttatctgtggaacgctcaggtaataaggacactataataacttactttaagccaaaacatccaaataaaaaggctggttataattattataaaaatcaataggaactataaatatataaagagggattgctatgccaaaattatatacatgtttaatttgcggatataaaggattaagtgaaaacccaataaacaatgatggtgagtatcaaaaaacatttgaaatctgcccttgttgcgattttgaatacggctacagtgaagatcatgaagtaagcttaggttttattgtaacgccagattacttaattgaagctgcaattcagttataccgaaaacaatggattgagaatgacatgaaaattgcaaatcctaaatatattccagatgaattaagaaacggtgactgcttaaaatttgaggtgttgttaaagcaattgaatagcctaaatctcgatacagaaaactttgaaatcaagggatttaatggttattaggcagcttcaagcccccggtatgggggctttcttattattgtaaagactatcagaagactatttaagtattaatatcattgattattctttctccatattcccctgaccaacacttcaacttctttaacctcaactgtttgctgcatcacatccctcctttttgtttttcgtgtatcaagcttgtacaatgacatcatcaagcaattcaacatagatcaattcttacctgaaggtgaatatcacccaaactataatgtcgctccttcacagaacatcctgacaatcattaacgatggatccaataaccgtctgggcaagcttagatggggccttatccctccttgggctaaagatgaaaagatcggatacaagatgattaatgctcgtgccgaaacactggccgagaaaccaagctttcgaaagccacttgtcagcaaacgttgtatcatacccgctggcaggtatacagaataccgttctgcattttcttcccgagcttccacccactcatagtcacccaccgtccagaaacgcggtgaagcttgaccgtctctgtcttgatatttcaactcttgctgaagttcttttaaaaactgaatatcttgattcattcatttcctcctatctgtttaaaatctcgattttaaggtaactttaaagtacatggtcttgagaaattcccctttaattggtaagctggcacctaggatcatacaaagcaggtgataccttgaaaaaaataatcggaataattggattaattgcttccttaattgtgcaaggattttcagcaagcggttcgttgactcatgagattgctatggcttgtctatttgtatttctaataatttataattttgaacatgctaaggatttctctaaaaaatctctaattgttttaggagcaatctttatagctctaatgctaggtatttatcaactcatttcctttagcggtgattactttgataggcttgacttaaatattggacttatcatcttacttgaaatcgctttgattattgttttggtatctattgcagtaaatttaatgaaacttattgcgaatcggttaaggaaaacacctcatggtaaagagttttaactcattgccttgtggtctcttatgtatgaaatcaaatgctttccctaattccttctcttctgttacgctgagtaataacaattacttgccatatcttatattgcataatacggttaatcagtcgagatcattgagggatcaaaatatggccaaataaaaaacgatggatgctccatttccattaaaaagacaaggttgaatatgtagtacttcactcagaacatttggcttattaaggatataataagtgttcttattaattttccctgttacgataacgatcaaaaacagagttatctatcccatttcaagccagaaattattctgcttttttaaaatgttcttgattttcacttttatatatatccataaagcattcggacataaccattatatgtaactgaaatgcaggtataagacttattatatagagatttaactaccaatatgtggggtctattaacatccaaatactcaaaagcaagaacaaatgtactcatagccttccatttccacaccttatccaaattttcattttcctaatttcattttaaatcgccctatttcacatcgtaatcgctatcgtaaaagcctatattatcaacgtttttcctcctgaaaaatttcccttttttatcaatatctccttaaaacaaccacttttccctactcccacttacgttttatcgtttacccctattcactaattaaagtatcaaaaatccttatgtttactgtcttttttaactcattataaatttttacgataagcatgttattcgtgtacgttatacgacttgactgtatttggtgacgatttaacagagaaatttaatgcacttctaactttttaaactgcaatgggtatcattgttgactcaacaactcaaggtatttctgatagtaaacaagcaatggattatgattcaccgagataaaacccctacccttctcttaatcgagtgagagagtatgacaaagctgctgaatatattgaacaagcagtctcattgtacgaaaacgataaatgtgaccttctccctcatacgttatttacactgacacaaatttacttcaaaatgaaggatattgaaaaagcctttattctttataaaaaaggaatcgagaaagcacaagccattaacgatgatgtcttagttgctgagtttaattacttaaaggctttatatatcgactctatagataaacgcacagttttccgaactttttctgtacttaaagataatgtaatgtatccagatttagaggaattagcactcgacacggctaattattgtaaggagatagggcaatttgaaaactcaaccaccttttttgacgtcatggtggatgcccgaatccaaatacaaagaggagagtgtttatatgaaatttaaacttgcattagccaccttgtcagttgtcgttggattagcaatttttagtggcttttcatcctcgaatgacaaagagttccatgaagctaaaaggaatattacttctattcaaccgaccaagttttttgtttaatatttaacccattagaaacattaccgagcaatgggtgctactaatttgtcaactcttgattaatcattagctaattaaactaaaaagaccgcactacgaaatacagtcagtgtggtcttttgtcttcaaaataaaattttaatggaaagtttgttaccacatatgcaaagcaagaaacgaaagcccccatgctaatatgccgaacattacgaagaacctaagaaaagtttcatattttgtaagtcttcgttctctttttattttactcaatctccaataaaaggcgtagccggagaacaataaaattatttgtcccagttgtgacacagattctaaaaattctatcccattcattgattttcacctcgtttatttatgagaaaagcaggttttattactcagatgaaaaaaccatttccaactgtttaagtaaaaataagtaagccatactatgtctaatggtataagaaaagatgtcctctgtgtctagtaaaaccatagtgtatggtggcagaatacgttatgtttctctattaaaataagcaaattaacattgcagttttatcatcttaactttatgatgtatgtccacaagtcagccctgctctgtgaagcgcagtaccagcagatgtataagaaactgctctaagaatcgctttcgaattgttttggctcggtgaaatccaccaccaagatcatctttactgtatccaatacccaggctgattgttcgaccagctttgttgtctgcacccttaccggaaaactcggtgtcatctaggtcagctacagacttaaacgcttttttaagcttcaccatttgcgaccttagttccttaaactctttggttcttttatcggcctcaaagagtaatgaatcagcctcaaataccttcatatcattctccttcctagactactctatgtaaattttaccacagtaatctatttgaataacagaaaaagacagccaaaatgactgtcttatacatcacacactatcttgttctataatcattttctgcggtatagtagcgccaatcccaaaaaggttccccattggccaatatataccggtctaaaaatatttcaaagtttacatttaatggattatattctaaaccactttcaaatatatagagatagttgggatcaccttcgttcactttatctttatcgatcattaaatggcattcttccaataagtagccaattggaataccattgatatcttcaaacaaatcctcatattttaactcctcttcaatctcttcaaggctaaatagctgaagtcctccacctatattctccccatcagaaagaatctcaaaaattttcgcgccgttatgcagtgtcatgaacttctgataatcctctggaagggtaatctgatgtttagcttcaaagctttgaatgtcgttaagggttgctttgtccggtgaaaaagtaacaaggcattccatggtatctccttcagaacaaaacaattgaatggctcctttttcatctaaaagacttttcaagccatttaccgtcttatgaacaaagttagtcacatacatcacccctttatttccttttaacaataaccctttcaaactccaaaagttgtggacagatcgtgataggcgctcttttcaatgaatataatgcaataaattctaaaaagaggtgcctccaaaaattgaattctctaatgaatgatgacatggtaaagatcattagaaatggccttagcgcatcccagcatccaaagcatattcttgttgtaggagctggattgtccgggcttgtatcagcatctttgctgaaaaatgccggtcacagagtaacgattctcgaagcgagcggcagagcgggcggccgtgtctgcactttgagagctccctttagtgatgatttgtattttaacgctggcccgatgcgcataccgaataaccattcgttaaccttagaatatataaaaaaattcaaattgccaacaaatgtatttatcaatagaacccctatggacatcatttatgcaaatggaatcaaaacacgtctccaagtttttgaacgagctcctggaatattgagatacccagttgcaccacatgaacaagggaaaacgtctgaagagctgatgctttctttactgcagcctattctaaattttatcaatcaaaatccagcgagaaattggcggattgtcgaagaacaatacaaaaattattcgttaagctcttttttaaacacgtatttttcatatggcgcgatcgatatgatcggtgtacttttggatatggaagcgtatatggggatgtcccttgttgaagtattgcgggaatctatctttttttcatcgcccgctcacttctatgagataaccggcggcatggatctgctgcctcacgcgtttcttcctcaattaaaaacaaacattctataccatcaaaaaatgatgaaaatgtctcagggtgaaaatagtgttacgatccattgtcagcatcaacaaacggcagaattcacatcattcacagctgatctcgctattgtaaccattcctttttcaacattgcgatttgtaaaagtcgaaccataccattcattctcgtactataaacggagggcaatccgtgagctaaactatatcagtgcaacaaaaatcggcatagagtttaaaagccgattttgggaaaaagccgggcagcgcggcggcaaatctattactgatctaccgattcgtttttcgtattatccaagcagaaatattggagcaaatggacatgccgtcattctggccagttatacttgggctgatgaggcactgatatgggacagtctttcagaaggagagcgaatccagtatactttactgaatttatctgaaatctatggtgatattgtgtggtctgaatttgtgtctggcacttcttttagctggagccagtacccgtattctgcgggaggttttacagctttcgaaccaggacaagaattagagctgtatccctatattcctgtccctgagggcagagttcatttcgccggagaacacgcctcactcactcatgcgtggatgcaaggcgcgattgaatctggaatacgtgttgcttatgaggtcaatcgcttaccttagatcatgctcaccttctgtactaaaagattattacatttcatataataagatcttgattagacggacaaattcaatcacaaaaacaaagtaatccttgcattccttcgccctccatgctatattcatatagcgatgagctgaattgtgtaagccgatgtacacgcctttatggcacacacgaatgtggcgtgtggtgcatcgcctcaatacgcaaagacgtttgccttaggcaaacgtcttttttgtgttatccgatttttgtgccgtttgaaacaggctgatccggctgcaaaaggacgacatcgccctggccgggtatgccgccgaggaccaagacttccgatttaaatccggcgatccggcggggcggaaagttcacgactgctatgacttgcttgttgacgagaccttccggctgataacgcttcgtgatctgcgcgctcgattgttttatgccgatttcagtcccaaaatctattacaagcttgattgccggtactcttgcttcaggaaattcttccgcttttacaattgttcccgttctgatatccaatttctcaaagttttcaatgactgccatatcaataactcctttttctcctattgtaaaggagatattcaagattcgtttaaccaaatagccattattttttatctgaatataaggtgtttcgatacaggcggggcggcattcctgtcctttttgtgaaccatctggtaaaagaagaaaggttttgaaagcccagcgccccgctcacgaaggtaagggtttcatttctctccatcagcattcgttttgcttcctcaaggcgaaggtcggcaatatagttctgcggggacttccctgtctgttttttgaaccagcttgaatagtaagctgggtgataatgctcgatttctgccagcttcttaatcgtcagccgctcaaataaatggctgtgaatgtatgcaattgaggcatagctatgggattgaagcttttcttttatgtattgtactagcatatgaagcgagttggctgttccggcctttgcttcctctgtcagcaagtacctgatcgaagaccagaaaggatcgagtgcagcttcaattcccgatcctgcacgaaactcatcaattttcattgcatgaagcggaacatccagtacaagacattcatttcttccgatagaacggaagcgatgctcgcactgcggcggaatatataaaaaatgatccggatttaatttcacctggcgcccctcagtctcaagatctatactcccttcaagcggaaaaagaaattggctgtacgcgtgcttatgtgaatgatataggcgtgtgtatgtccgtttttcgcaaatcatctcttgaagcgaatccatcagcaacccccttcctttggtcatcttttaatccggtaatggtgttccgatataggcgaaaatccgattttttcatataaagaaactgccgccagattttctttcatcacttgtaaaaacatgcgttccgctccgttgttttttgcccattcagtcaacaccctgatcacttgggttcctgccccttttcctctgtgctcctcagctacaacgatattactaagtccgccataaccatcaatgacagaaaccgtgccaagcgctgtcaggctttctttgtcatacatcttgaaaaaagttttacacggcggcatgcgttcgaaaatgtgtttgtaacctttgtgacgctcgggtgaaaacccttctaattgaataaattcatctatccaaacagatgatggctcttgttcccacttgtatgtaaatcggctgttgtcatttgttcggctcataattgaccggcacaacgctgtcatctggaagcactcgtctaccttttcataacggctgtctgccaatgcgtcatcaagccctttcggtgatgcgttgctaatatgaaaacaaacaggtaagcctaaactttgataaaaaagttcggcctctagctgaaaatccccttcaggcatatccgcagacgtccatacgctatttgcccttttggttacgccaaaattcgctctgagaagccattgccctatgcttttttgaaaataagccggccatgaagctgccgctaatcgttcaatcttgtgaatgtcatccattgcataatgcctctcccctatgtatactcccttgatattatacaatattcagaaatataagacatccatttatttgtttacataatatttttattgtttattaataatcctgacaaaaatgtcctaattgaaaatgacaggctttctaaaatgtcctcctcacgttcaaatgcttcttttgcgattaaagcagtaaagccatgcagcaggcttctgagcccccttgtcgcatgaatggcagtcttttcacttgcatagccgttttcaatgaacagcttcgtcacaagacagacaatttggtcagagacgatttccgcccttttgtcctgaaccttaagcagagccgcttcataatatccgggattttcaattgcaaaatcaacatatgcatgagctaaagaaagcatagcggaatctccctttcgttcggttacggagtccgccatttgatcaaaaagctttgtcagtcctctgacagcaagttctgctctgatcgcttgcagcccgttgatatggttatacaatgacggggggcgcacattcatttttttagaaagtgccgcaagtgagacaccatttaccccttcctgatcggcaatctccgctgcagtgtctacaatcatttttttggtcaaacctattctcggtgacattgctcatcatcctttctttgctttttggatcgcctgtctcatccgctctgaaggtgatcgcaggaattttccatgtccgacagcgagacaggaaggcgccttatcggcgagcaattgtgcgcttttgatggcctcctccttattccatgtagcgaaagcgggaaaaggaaacgtccattttatctggcctgaaacagcgattcctccgcgcaactgaaacgcatctcctgctattaaagtgccgtttcttgtatcaagaaatgacatgctgcccggtgtatggcccggtgttggaatggcaagcagggaaccaattgtttcaccgcccgtcagcagttggtgaggctttgtttgtatgtgtttcggaatacctccttttataggcgtctgcggctcatcttgccgcaaggatgtgtcaccttgaagcaagaatgaatcccgttccgagatcatgacctttgcatgcggaaatgtttgtgccaatgtatccagtgatccgacatggtccccatgtgcatgagtcagtaaaatatgctgaagcggttttccaagctgattcacagcttgaataatccctttatagctgcctggcagtgcggcatcaataagggtgacttcgttttcttcctctactaaatagcaattaaccggaaacaatgctggaaaaaaagtcagctgccaaaccgtttggtactgagtaattctcatctttttattcctcctaacaaaaactaatggtgttagttttattattaactaacaccattagtttatcaagagtttattatttttttatcgctacataaatgttaacttgtgctcgctgtggcactgcggcactttgatcatacatctcaaagtcacctgtaaacgtgcgcagatgccgcttatcccaagtccaaatttccttccacgtttcaagcacaatctcttcaatagggccgattctggaagtgaaaacggcgtaagcggaagccggcaaattaatgttttcatatggttccggaagagtactgctgtgttcctgaaacgttccgactgaaaacgtataaaacccattcgtctcttgttcataattcgaatataaggcaataatgctcttgtctttttcagcctgtgataaaagagcgctcatatcctgcttccagaattgatcccacagtgccggaatcctcctttcttccgtcatttccagtgcgttgcttgtccgttgtgacagtccggcaaatcgtttccggtctaagtgtgttatatgtgaaaagcccatacgatctcctccttttgttaagattatagacaaagaaacctgacagcagtgtgtcaggtttcatatattttttgcatgtgatgaatggtttcttttactttatcccgtatatgaagaggctgcagaacctcaatatcctttccgaactggagcaaaaaaccgatcagccattgatcttctggaagtgaaatcactgcccggcagatttcatcttcctcacaacagtgaaggacatcatatccgaaccattcacctatacgctgacgtgctgccggctgaacaagaataaccagttcagttaaacggcccttctggtaccaattcttatcccatggcaaagtatccagctgaatgtcttttctgataaaggtttgatgtaagatggccagatctttcatccggttcagtttaaataagcgaaaatcatttctcaccaagcaataagcgtataaataccagtgccccgccttgcaaaccaatgtataaggttcagtttcacgaagaagtgtttccccgcttgcgcttgtatatgtaaaagatatcgttgacaaccgatcgatggcagcgcttattttctcgcgcagcgtcttttgatcctcagtatggccccaagccgtcatgtcaataaaccatttttctgtttggtgcttaaatgcttgagcagattgctcaggtataaggtgtttgattttttgataggctgtgctgtgagaaacgggttcatacatagatgaaacgctctgcaacgcggaagcaattgcaaacaattcctcctccttcagccactctctttcaagccgatacgtttccatgatgccaattccgcccccggaaccctgtgaggtcacaatcggaataccagccctattgatcgtctcaatatcacggtaaattgttctgacagatacttcaaacagctcagcaagctctgcagcctgcacttgttttttgctgatcaataatacaaccatcgctaacaaacgttccagtttcattctgcgcaccttttcttcttgtattttccaacaaaacaatcataacattttgataaagcttgggcatatctattatgcggcggaatacacctcgcatatgctatgaaaacaggggtttcccttcttttttgtgttcagtattttatttcagctactatttccaaccggataagcatacacttctcaacggaggggatttcacatcatgcatcttacttttcagagcgtttatcctgccatgatcatcatcttttttctgtataaaaaaattaaaaggtccatcggataccagccgctgaagccccgctggctgttcacccgcgtcattcttttctcgctgtttgcttttggcctttcaatcttcagcgccattcacccttttttatatggatatctcattttgggcattcttggcggatggctccttgtctttttcgctaagaaaaacatctcctttgaaaaacgcagaggaaagatctattttcggactcatatttgggtagaaatgattctcttaaccttattcctgtcaagatttctatatcgagtgacagagctttatcttacctcgcctgatctaaacagccttggatcttacagtcagtcaatcggaacggaccctctgacaataggcgtcttttttctgatagccgtttattatatcggtttttcttcttttgtcatcaagctcagcagaaacgaactcgaacagcacggacacaataaagaaaaagacatccttgcccgctagcagcgagttaagcaaggatgtctttttcaatcatgctgtgtatgatggatcatttgctgaagaacatctaaaacatgttcatcctccggagagtaataaatcgatgttccttctctgcgcgatttgacaagtcgaagattttttaaaaatctaagttggtgggacacggtggattgcagtaaattcagcttttctgcaattccgtttactgcatgctcaccctgggacaataaatggagaatcctgattcgggtaggatcagaaagcgctttgaatgtttgcgcgactagaaacagcgtctcctcgtccagatcagcagccgattgttccgtttctctaaattcagtcatatgtatcacctttctttattcatagttttatcttataacaaatgcgcttgagtgcaaaccagcctgcttgtattccatttcaatctcatagtttaaatttatgtttcaaatcaggtttttacttggtctgatataccgtcttatgtcataataaaaaaggtcatactgctccaaacattgagggtgaaacacagtgaagaaaaagagaaaaggctgtttcgctgctgcgggttttatgatgatttttgtctttgtcatcgcctcttttttattggtcctgctttttttcaaccgggatttaatcaaaaaacttccgatcgatacgaaaacgattgttttagaacgtttaaccgattacaaacccttggtggaagaagagcttgaaagccaaggactctctaattatacatcactcatattaggcatgatgtatcaggagtcaaaaggaaaaggcaatgatcccatgcagtcctctgaatctctggggttaaaacgcaatgagataacagaccctcaactcagtgttaaacaaggcatcaagcaatttaccctcatgtacaagaccggtaaggaaaaaggcgtggatttggataccattattcaaagctacaacatgggggcaggttacattgattttgtagctgaacatggaggaacgcatactgaggaattggcaaaacaatactccgagcagcaagtcaaaaaaaatcctgatctgtatacttgcgggggaaatgcgaaaaatttccgctatccgtattgctacggtgattatacgtatgcagaaaaagtaaaagaaaaaacaaaaactgttgaagaatctttgcaggttgcaacacttgaaaccatggaatccaaggctcatgaataagagtctatcaatttactgacaaaagcccaaaaatgaatttgggcttttgccatgtttacacgtaaaaaaagccatactgagtatggcttttaataatacggtgaaatcatcaaatatacaataacgcctgtaaggcttacatacagccatagaggcattgtccatctcgcaatttttttgtggcgctctacctgcatgctgaagcctctgatcagcgtaaacagcgcaagcggcacaataattgcagaaaggcagatatgtgtaattaaaataaagaaataaatcgggcgcataattccttctccgccataaagcgtgttttccgcaatcgagtggtacgtcacatagcaaatcaaaaatagtaaagttgttgtgaatgcggccaaaataaagcgtttgtgagctttgatatttttctgtttaatcataatcagcgcggccaataagaagataaacgtaaagctgttgaatatcgcattcagcattggcaaaatgtgaatattcgcatggctgaactgatctaatttaggcataaaaaacagcactgcgattaaaccgttaatcagaactgtcagcgtaaggacaattcccgtgtaatttttcggtttattttctgtttggttcatttggtgacctctcctaatttgtactggctatccaaatcgtatgcaaattcaaagaagatgtcaacggtttcgattgcttcgtcagaaattagacacacttcaaaggccggaggctattagccccggcctgttaggtttacgcctcttttatcaaatgttcaatgaccttatgttcattttcattcagcaggttcttttgaattttcgaatgaatgggtttattcatatgctgatccaagatatcggccgtttctttatccccggcgataaccattcgttcccatcttttcgcggcagctttttgatcaaggctggcagccagccgcttatacagtctcgattggttctctgttacatgttccctcatccggttctcttcaaatcgtgccgctttgtctacagctgaatggcaattcttccaagattcattgatcatatcatactcataacactccaccgcctcaattttccctaaaacggtttcaataattttcacttcatgctgctgagttaaaataaacgccgtacttgggtatgtctggcgcaaaccctttagctgatccaggacagctgtttcttcccagtaaaatcttgtatctacagggacttgaagcttaataggctcccatatgccgctgtcggaaacaaaaaacacgagactgcggggcatgtcttttcctattgcattcaagtattgattcattttagccctgattccatccagacacttttcctcctctggatcactaactgccaaatactcttttaatcggctgaatcctgactttagggcaatcttccattctcccccctgctgctctggatctctcatgtctgtattgagatacagggagagaattttatccggcggttccaattggacatactgtaatttgttaatcaatgaatcaatcgccattctgattcctcctttttcacaggttagttttctttttcctctcttaaaaacgatcaaacctgactttccgctaatttctagtaataatggaattgttgtttacaatacgcctctcttctaatacaattggtaactgtgtttctaagctgatttttgaaaggagtttgatcttgtttactattaaagaaaaaaatcgtcaagagcttgaagaggaattaaatgatttagaatttcaaatttatcgcatgcaggagaatatgaaggatttatctaaagatgccaaagtgcttggtattgatcaatcgaacaatgaagaatggatgattgtttcctcgattgatgatggccaaacatgcaaaattatgctaactgattgtaaaacggcttaccgaggaaaaggctgtttttcacttgtagcgtcttacaaggacgatgccattcatataggcgatataaaaggccctccgaatcacgggtttggttccatttgcatgaaatatttaaaagatatagcaagagaccacaatataccgaaagtcacaggagacatcgccaaacgggattggaatcatgtagaccggctgattcacttttatgaaaaacatcaattcaaagtatgtatcgatcatgatacccaatccggcagcattaagtgggttgatttgtaaaaaagtctggaagaaagagccaagatatgctgtaatggtataaaaccattgatggagggttctatgtacgcctcaaaactgaaaatgggagacgaaatccggatcgtgtctcccgcgaccagcatgtctatattatcaaatgaagcaaaaatccaagcaaaaacggcgttagaacgcttaggttatcgggtaaccatcgctgaacacgcaaatgaatgtaacgaatttgattcatcctctatcgagtcaagagtccaagatctgcacgctgccttttttgatccaggcgtcaaagcgattttaacgacactcggaggatttaattcaaatcagctgctgcgttatcttgattacgagaaaatcaaacgacatccaaaaattctgtgcggctattccgatataaccgctctttgcaacgctatttatcaaaaaacgggtcttgttacgtattcaggtccccacttctcaacatttgcaatgaaaaaaggactcgattatacagaggagtattttctttcttgctgcgcttcggacgacccgtttgaaattcttccttcaagtgagtggagcgatgaccgctggtttttggatcaagaaaacaggcgtttttatcctaataacggccctgttgtaatccaagaaggttatgcggaaggcactttaattggcggaaacttatgcacgcttaatttgctgcagggaacggagtattttcctgaaacagaacatactattttattgattgaagatgattatatgtcagacatccacatgtttgaccgcgatctgcaatcactcatccacctccccgctttttcacatgtaaaggcgattttgatcggcagatttcagaaagcatcaaacgtatcaatggatcttgtaaaagccatgatcgaaacaaaaaaagaattatccggcatcccgatcatcgcaaatataaatgccggacatacctcgccaattgccacgttccctataggaggaacatgcaggattgaagctatttcgggcacatcacgaatatggattgataagcattaatcagcttgtaaatttttttacaagcttttttagcgcaatcggttatgcatgccgcacgagacatgacaaatgtcatataggaggcatgatgtgtgctactacaaaagacttctctcattagcgtatactgaaccgagacacacaatgagaggatacttactatgactgaacaaaccattgcacataaacaaaaacagctgacaaagcaagtcgctgcatttgctcagcctgaaacaaaaaacagcctgattcagcttttgaacacgtttatcccattcttcggcctgtggtttcttgcttatctcagcctcgatgtctcctatcttcttacgttagcattaacggtgattgccgcaggttttctaacaagaatttttatcatcttccatgactgctgccatcaatcttttttcaaacaaaaacgctataaccacattctcggttttctgacaggtgtcctgactttattcccgtatcttcaatggcagcacagccattcgattcatcatgcaactagcagcaatctggataaacgcggaacaggagacatctggatgttaacagtaaacgaatataaagctgcatccagacgaacaaagcttgcatacagactttatagaaacccgtttatcatgtttattctcggaccgatttatgtttttctgatcacgaaccgttttaacaaaaaaggcgcaagacgcaaggaacgtgtaaacacataccttacgaatctggcaattgtcgcgttggctgccgcttgctgtctgatctttggctggcaatcgtttttactggtgcaaggcccgatatttctgatttcaggttcaatcggtgtttggctgttttatgtgcagcatacctttgaagattcttattttgaagcggatgaaaactggagctacgttcaggctgctgttgaaggcagttcattttataaactcccgaaactgcttcaatggctaacaggcaatatcggttaccaccacgttcatcatttgagtccaaaggtgcctaactataagcttgaagttgctcatgaacatcacgaaccattaaaaaacgtaccgacaatcaccttaaaaacaagcctgcaatcactcgcgttccgtctatgggatgaagataacaaacagtttgtgtcatttcgggctataaaacatatacctgtaagccttccgcctgattcaccagaaaaacagaagctgcggaagaatgcctgatgataaaggaggtcttctaatatactagaaggcttcctttttattgttggagggtgcattctggctttcacaatgataaagttacaagtaagatgaaaagctgaaaatgaggtaagatcatgattaaaaatcattttacatttcaaaaactaaacgggattacgccctatatatggacgatatttttcatcctccccttctactttatatggaaatcatcatctacatttgttattattgtcggcatcattttgacgcttttatttttttcggtatatcgatttgcttttgtctcaaaaggctggaccatttatttgtggggatttttattaattggcatttcaaccgcctccattaccctgttcagttatatttattttgctttttttatcgcgtattttattggaaacattaaggaacgcgtcccttttcatattttatattatgtccatttaataagcgcagccgtcgcagccaatttcagtctcgtattaaaaaaggaattctttctgacacaaattccttttgtcgtcattaccctcatcagcgcaattttattgccctttagtataagaagccgcaaggagcgcgaacggcttgaagaaaagctcgaggatgcaaatgaacggattgcagaactggtaaaattagaagagcgtcagcgaattgcccgcgatctccatgatacgcttgggcaaaagctttctcttatcgggttaaaaagcgacttagcaagaaaattgatttacaaagatcccgaacaagcagctcgtgaactgaaaagcgttcagcaaacagcgcgaacttctttaaatgaagtaagaaaaatcgtttcctctatgaagggcatccggctcaaggatgaactgatcaacatcaaacaaattctcgaagcagctgacattatgtttatctatgaagaagagaaatggcctgaaaatatctcattgctgaatgaaaacattttgagcatgtgcttaaaggaagctgtcacaaatgtcgtcaaacacagccaggctaaaacttgccgagtagacattcagcagctctggaaggaagttgtgattacagtgtctgacgatggaacattcaaaggagaagaaaattccttttcaaaaggacatggcttactcgggatgagagaacggcttgagtttgcaaacggaagccttcacatcgataccgaaaacggaaccaagcttaccatggcaattcctaataattcaaaataaacataaaggatggcttatatgattagtatatttattgcagaagatcagcaaatgctgctgggcgctttaggatcacttttaaacctagaagacgatatggaagtcgtaggcaaaggtacaaccggcctagatgctgttgattttgtcaaaaaacgccagcctgatgtatgtattatggacattgaaatgcccggaaaaacagggcttgaagctgctgaggagctaaaagatacaggctgcaaaattatcatcttaaccaccttcgccagacccggttactttcagagagctattaaagctggcgttaaaggctatttgttaaaagacagtcctagtgaagagctggccaacgccatccgtagcgtcatgaatggaaaacgcatctatgcacctgagctgatggaggacttatacagcgaagctaaccctcttacagatagagaaaaagaagtgcttgaacttgtggctgacggtaaaaacacaaaagaaatcgctcaggaactcagcatcaaaagcgggacggtgcggaattatatctcaatgattctagaaaagcttgaagtgaaaaatcgaattgaagccattacccggtcaaaggaaaaaggctggtttaaataaaaaaggatcttggcatctgccaggatcctttttgttaacctgaaattcccgtttgagaacctcgccgcaaccagaattaaattgatcgatatcctcgctcctatacccgctgaacgattgcttggttaacagcccaataaaagactggattgaatgatatccctgttaaaatggtcggccattgcacatcagcagaatttctgatattgattattttgtattttcagtatgacaaagttgtgccacttcgctcccgaagctgccatgcccaactgcaagagcctaatatcacaataaaaaaccgtctgaaatcaatccgattccgttccgtaaatggcatctgctacatccaactgcttattatctgccaaaaacaccagctcgtttcgctgatcaaagatattaacaaccagctataaatgtcatgatgccgaatgtctctgtaatgtggaatcaatcatttaacccgagagcccctgaatcgcacataaagagaaaaacgggaccactttcttttatcagcatatgatataaacagctctaagcagaacaaaaaaagacacaagccaaaagctcatgtcttttatcacaatctatattattagtttaagactttaacacttacagttttgacgccccaattagaagcatcacttttacttggtacaaatacgtcgattttatttcctttaatagcgccgccagtgtctgctgctgttgcttccccgtagccttcaacatagactttagaacctagcggaattacattaggatcaaccgcaataactttcgcgttcgggttcttatttaagtcaatgcctgtagctgtaacgccggaaatgccgccgtcgttagcagtgtaagcagtagcagtaactgttagttcttttgaagcttcttgattatttgtatttgattgaacagccttctcctctgtgttaacagaagtttctgcctcagcctttgtttcttgtttaggttgctgttgtacagcttcttgtttaggttgctctttttgcacagcctcttgttttggcgcagcttgaggtgcgtttgtttgcgcattctcagtagctgtgtttgctgctgttgcctgaccttttactgaaagagttgatccagcatagatcatgtcagagcttaagttattccaaactttcaggttgttgactgtcgtgccgaatttttgagcaatcttagaaagcgtatctcccgctttaattgtatattgcccagtcgtggttgtttcttctgaagaaatggtcagtttttctcctgcaataattttatcagaagttaacttgttccattcttttaagtcctttaggttcactccatttttctgagagattccccagagcgtatcacccttttgcaccgtaatttcttttgcagaagcgtgagctccgaatgcagttgttgaaagtgcagcaactgccacaaaggacataatcgtcttcttcataagtaaatcctcccttgttagctttttattggcggctaacaggtgatatcgtaacacacgtaaatgtcaaatcaataacaaaaagatatgatttagattacagttcctttacatgaaggatttctctctgatggaaagacttgctgaacccttgatataataggcttcgcaggtctttttattttgaggcaaaacagagaaaataaaatgtgttttttatagaaaaaaagattgtttttctgttttttagtctgtcatccttgcataagcttgtatttcttgtaaaaaaagccggccgtattttgctcttttttgttctccgactccttttatagacaaaagttcatcatcatttacgggctgttttcctgacatttcttttaacgtttggtcagagaaaacaacaaatggcggaacaccctgctcagccgcaatttctttccgaaccatgcgcaatcgttcaaatagctcgtcattttcagtaatcgctgccgcttttaacgcttcttttctcgctactgataattctcctttcagcacattccttcctttactgctgacaaaaagagtcggaaacgttccgtctgacatcctgatgaagtcgtcagaaataagaaattcgataaaatcactgatttcgccaacggattggtgttttaatatcccgtatgttgaaaggtctgaaaagccattttcaagaacttttttatttttggagccggcaagcacctgggcaaccatcgtcttgccaaaccgttctttcatgcgaatgatacaggataagaccatttgcgcctcccgcgtcacgtcatgggccgctcttgtatcggtacagtttccgcactgtccgcacgcatcaggctccttttctccgaaatacataaggataaaacgctgcagacaatcttccgtatgacagtagtcgaccatttgtctcagtttttttaaatcctgcttttgtttctcttcatgttctgattgctcaattaagaagcgctgcaccataatatcctgcggtgaaaacaggagaacacattcactggcaagaccgtcccgtccagctcgtcctgcctcttgataatagctttccatatctttcggaatttgtgcatgcagaacaaatctgatatttgatttatcaatacccattccaaaagcagaggttgccaccatcacttgaagctcatcattaagaaacctttcctgctgctcttttctctcatcatcagccatacctccatgataccggcctgccctgacctgatttcgtttcaatctctcatatatccgatcagcttcttttctggtcgctgtatagacaattcctgcttcatgcctgttgttttgcacatattcgtctataaaccgatctttattttctccttttactactttaaaggttaaattctctcgggaaaatccggtatataccgtgttttctttttgaatatgcagctgtttgcaaatatcatcatgaacctcgggtgtggctgttgctgttaacgccatgatgacaggcttgtcgtgtaattcacggaacaagatttcaatattcctgtagcttggcctgaaatcatggccccattgagaaatacagtgcgcctcgtctattgcgaccaaaggaacatctatgccctgcaaaatccggataaattctgtggacgttagtcgctctggtgtaatgtaaaaaagcttataagccccttctttgagtccgttcagcctctcatatatttcctgattggattgtgtgctgttaatgtaggcggcgttaatccccgcttcttctaacgcatcaacttgatccttcatcaaggaaatcaacggtgaaatgacgatcgtcgtcccttcaaacattagtgccggaatttgatagcaaatcgatttgccgcctcccgtcggcataatgcaggccgtatttcgcctcgcttccgtcaccaagcggatcgcttcatcttggccgctccgaaacttctcataaccaaaataatgagccagaagggattgggctctatgtaacataacgtgtaaacctcgcttttccttgaatttctcccatcatatcataaaaaagcggccttcatttctttcacacaaaaatggaatattcactataccaaacctttttagataaaataaaaagccatttccgaaaaggaaatggctttcgctacgtcttgccgtatgcaagtaagaaagttttaaaccaccactcctcaaagtgggtgtttgcagaaacgttcctgtcgtcctctgcaatggaggcatgacattccggcttcgatataaaactccctattacagcttaaaggttaaaacttaattaacaatacgcacaaagtagcttctttaatatagtacaccatcaggcggttttaatcaagaggtcagaacaattgtttagaaaaactttttccagtgaataaaactgctttttctccaaaatacctgacaattcgacaaacaaaaaatatattacaataaaaaaaacagcctttttcgctaaaagtgaatgattattttcttctatattaatgtgtatatacaaaaagactcctatttgtaacgataggagtcttggctttattagaattttgcagcaagatcttttgcttcttgtaaacctttttcaacgatttcttgcgcttgatcaggtgctgcgttatgtccttcgatgacaactgtgtgcaagtcttgaacaccccagaaaccaagaactgttttcatgaagtttaatgacatttcaagtgcagccattggtccttctgagtagacaccgccgcgagcgttaagaagcgcaacttttttgcctcccattaaaccgactggtccttcttgtgtgtatttgaatgtaacgcctgcgcgagacagataatcaacataagtatgaagcactgctggcactgtgaagttccaaagcgggaatgcgaaaacaactttgtcagcttttacaaactggttcagatatttgtcagcaattgctgcttgttttttctcatcttctgtcatttccattccttgacctgctttaaatgttccgttaatcatatctctgccaaggtaaggaaggttttccttatgaagatctaattcaaccacttcatcattagggttgttttctttataagcagctaagaaagcttcgtaaagtttagttgaaacgccttcttcagctgtacggtcgcttgattttacaaataaaactgtagacatttgtattcctcccggtaaactttttatatttacttacaaatagtatgttactttcttttttacgcaaagtcaatcactttattttgaatatgagattttttttcaaaaaaaagcaagtacatctaatatcggtgtacttgcttgccatttttacttcgaatcttgttcacgatctaagatttcatacgtctgcgagcttttttgatcaattgtttctttgttggataagtcttttacctgttcatgaaactctctttcataagaaggagcatctgtctccagatcatcctccacatcagcttgggcctcaactgtcattcttgcataaggaacagcttcaagtctttcgtaaggaatctcttgaccggttttttcacacacgccataagttccatctttcatcttttgtaatgcacggttgacctcctctaacagctcccggtcaatctctttcactgtttggtctgtcatccggtctgtgacgagcgtcccgtgatctgccatatggttgtcaaccccattggaaagctcccccacttcttccgtcattgattctgtttcctttttctcgccagacaattctttttgcatatcgagcaatttatgatagagatgctgtgtttgttcttttgtcagtgccatgtatatcctctcctttctatcctgtttcccgttttgccttctgtcaaacatgggaacatcgatggaaagatgagctactgcctttttgaacggatcgtgaccgctggcgtcgatggtgcttcgggttttcgttggcactttttgttcttctcttctggcggtatataataggttgcgcctatatttaatctgccgctcagttcatcaatggtcagctcgccgaattcaagatgatagtcaattttttcgacattcagcgtttcaatatgtatataggtttcttcagattcctgtttgctgctttgtttctgtttctcaagcactgaaagtctttcttcacattcacgcagtttgtcaagttctggtttcaagcaatgcctgatcagcgaccggaacatttttttcatgacatcacgaccctttgcatactcctctttcgtctacatatataatgaggtatatcccatagaaaggagaggttttcatgcttccgactaacatcaatatttctcatctcaagactaactcgataggcaccggctcatcccttacctttggttctgcggagttaaggaacaggtgctctgctatcaaaagaaataacggttttggggaacaaaatgcagatgttattgttatggtcattccgattgaatcaattgatgaccgtgatggggcagatgcactcagtatgaaaatcaatcatcaataacaatggttttcgcttgaccttcgtctttttgaatggtgatgtataggattccgtctttaaaaatggcattcatctttccatgaagatggtcggaaagcggaattttcttttcaaaacttccgtatttcccttctttttggcgaaagtcctgttcattaaaataggaaaagcgctgccccttcaccactaaataatctccgtacgataatatgtgaacgtcttgtttacggtagcctggaagataaattaaaaactgcacttccgtaacggtatctacaatatccatgctcggaaatgaagcatctcctttccctcgctgatcttgctgcgcaaacggaaacggagattggccatttgtcataaaaggggttttttggtcttcatcaaatacctgtttccaaaagtcaccgccatacatctgctgtgcgaattccatccactgcttcatcttttcgaaatccatttgaagccccctgtcttaacatactttataaccgccagcatacaactatagaaaggaggtttgcctgtggttcaaccaactccgtatatcaatattaatattttcatgctgaaaattaattcctttgaaaatgcttcagcggttaacgtaggacaaaatttattggcagaatggcaaaattcagataaaaaaaatcaaggctacggacagaattttggagatgcgagcggatttatgggcacgagaagccatgtggatgacagagaccaaattgattctccggcctcttttgaaagtgaagcggttaactcctcaatcaaaaggaagtgatgagatgttcttttcaccctccgtcgtgaatgtcggcggatttaaaatcaatacgatggaccgtggttcctctttaacactcggtccgtatcagcaggtcgattactttttatcagctaaaataaatcaagggtttggggaaaatggcgactttactcctcttgtcgtaccgatttcaaatgtattagatgcagatcttgttgattcgaactcagcgaaaaacagtgtggtgtaataagaacagggcgcacatgccctgttcttgtttttatatataaaaaaagcctaaccattttttgaacggctggctcatcaaatattcagctgcacaaatgctttgtcagcaccgcctgaacctcgcttaaatcggtgtctttcgcaaattctaattcgaacgttttgcttcttgtcatcaataaaagcccagtgtccggatcaaacattcccgcttcttggatggcaaagctttcaattgttttatatggaagaaatacacgaaccttctttttagaaaacattttattgtcaaagaaaatgatccgcttatttgtaaagcaaatttggtccactcggagcttataaatcgattctattctttccccttcaacgagcaaagcctcaagcttctttgcatccgttgatctgctaacagaaaaaatacccaatgaagaacccctctttctgcatttatctatttgttttatcattcactacataaaaataagtcctttatccctatataagaatacgacatagaagacatttaaaccattacgaacagattacatttttcaaatttttgatttgttttttggcttttaagctgttgtcatcaagtaatacgcacatatagagaaaaaagtttcaatattcagcaatgtttttataaaaaagtggtttttaatgatttttttaattttgttttatatttcctgttttaaccacaaaaaaaccgcagctgagctgcggttttatgtatcgactgcttttaacaaaatctgtttgatgcttcaaggaagcattacatctcttcgaagtattctttataatagccgccgactttattcgtattgtcgaccacaaagagaaactcctctgtttcattttttacttcatattcttttcccggcgttaaaacgcggtttacgatatatttttttgcgtttgtctgcacacactttacttttttaattgtttctttttcaagccaatttttatgaatcatgatgaaatctccttttcttatctataagtttattgtagcttttttcttttgtaaattgcaatatcggttattcattgattttgccttgatttctattatagaatgtttgtatacgcttacgtttgaagcaactatcacagcttatttctgctattcaatccaggaatcaatgtgctatcaccaagaatctcagaacagaccataaaaaatgactggaggtttgttacggatgagttctttaacgatgcaagtgacgaaaaggctggagacatttttacagggaacaaagaagctttatattgacggaaagtttgttccgagtgcctcaggggcaacctttgacactccaaacccggcgaccggcgaaaccttgatgacgctgtatgaagcccaggctgcggatgtggacaaagctgttaaagctgcccggaaagcctttgaccaaggtgaatggagaacaatgtctccagcttcgagaagcagactgatgtataagctggcagacttaatggaagagcataaaactgagcttgctcagcttgaaacacttgataatgggaaaccgatcaatgaaacgactaatggagatattccgctggctattgagcatatgcgctattacgccggctggtgtacaaaaataacaggacagacgattccggtttccggcgcttattttaattatacgcgtcatgagcctgtcggtgtcgtcggccagatcattccatggaatttcccgctcctgatggcgatgtggaaaatgggcgcggcacttgcaacaggctgtacaatcgtcctcaaaccggctgaacaaacaccgctttcagctctttatttggcagaattaattgaccaagccggtttccctgccggtgtaatcaacatcatcccaggattcggtgaagatgcgggagaagcgctgacgaaccacgaagcggttgataaaattgcctttaccggttccactgaaatcggaaagaaaatcatgtccaccgcagcgaaaagcattaagcgtgtgacattggagctgggcggaaaatcgcctaatattcttctgccggatgcgaatttgaaaaaagccatcccgggcgctttaaacggtgtgatgtttaaccagggtcaagtctgctgtgcgggctcacgtgtcttcattcataaagaccaatatgatgaagttgttgatgaaatggcatcctatgctgagtcactccgccaaggagcgggacttcataaagatactcaaatcgggcctctcgtaagcaaggaacagcatgagcgcgttctttcctatattcaaaaaggaaaagatgaaggagcaaaagcagtgaccggcggaagctgtccttttgaagcaggatactttgtcgcaccgactgtgtttgcgaatgttgaagacgaaatgaccatcgcaaaagaagaaattttcggacccgtgctgactgcaattccgtacgaaacagtcgatgaagttattgaacgggcaaaccattcagaatatgggcttgcggccggactatggacagagaacgtcaagcaggcacactatatcgcggaccgacttcaagccggaaccgtttgggtgaactgctataatgtgtttgacgcggcgtctccatttggcggttataaacagtcaggactcggacgagaaatgggatcatatgccttggataattacacagaagtcaaaagtgtatggataaaccttgaagactaacatgtatgtttaaaaaactgctgcctgccagcagtttttttctttctgtaatggcagtaaaagacgctgaatatatatgcttctgaaggagttgagcgtgatgggcacacttcaggagaaagtgaggcgtttccaaaagaaaaccattacggagttaagagacaggcaaaatgctgatggttcatggacattttgctttgaaggaccaatcatgacaaattccttttttattttgctccttacctcactagatgaaggcgaaaacgaaaaagaactgatatcagcccttgcagccggcattcatgcaaaacagcagcccgacggcacatttatcaactatcccgatgaaacgcgcggaaatctaacggctaccgtccaaggatatgtcgggatgctggcttcaggatgttttcacagatctgagccgcacatgaagaaagctgaacaatttatcatctcacatggcggtttgagacatgttcattttatgacaaaatggatgcttgccgcgaacgggctttatccttggcctgctttgtatttaccattatcactcatggcgctcccccaacattgccgattcatttctatcagttcagctcatatgcccgtattcattttgctcctatggctgtaacactcaatcagcgatttgtccttattaaccgcaatatttcatctcttcgccatctcgatccgcacatgacaaaaaatcctttcacttggcttcggtctgatgctttcgaagaaagagaactcacgtctattttgtcacattggaaacgcgtttttcatgcaccatttgcttttcagcagctgggcctacagacagctaaaacgtatatgctggaccggattgaaaaagacggaacattatacagctatgcgagcgcaaccatatttatggtttacagccttctgtcacttggtgtgtcacgctattctcctattatcaggagggcgattaccggcattaaatcactggtgactaaatgcaacgggattccttatctggaaaactctacttcaactgtttgggatacatctctaatcagctatgcccttcaaaaaaatggtgtgaccgaaacggatggctctgttacaaaagcagccgactttttgctagaacgccagcataccaaaacagcagattggtctgtcaaaaatccaaattcagttcctggcggctgggggttttcaaacattaatacaaataaccctgactgtgacgacactgcagccgttttaaaggcgattccccgcaatcattctcctgcagcatgggagcgaggggtatcttggcttttatcgatgcaaaacaatgacggcggattttctgctttcgaaaaaaacgtgaaccacccactgatccgccttctgccgcttgaatccgccgaggacgctgcagttgacccttcaaccgccgacctcactggacgtgtactgcactttttaggcgagaaagttggcttcacagaaaaacatcaacatattcgacgcgcagtgaagtggcttttcgaacatcaggaacaaaatgggtcttggtacggcagatggggtgtttgctacatttacggcacttgggctgctcttactggtatgcatgcatgcggggttgaccgaaagcatcccggtatacaaaaggctctgcgttggctcaaatccatacaaaatgatgacggaagctggggagaatcctgcaaaagcgccgaaatcaaaacatatgtaccgcttcatagaggaaccattgtacaaacggcctgggctttagacgctttgctcacatatgaaaattccgaacacccgtcagttgtgaaaggcatgcaataccttaccgacagcagttcgcatagcgccgatagcctcgcgtatccagcagggatcggattgccgaagcaattttatattcgctaccacagttatccatatgtattctctttgctgactgtcggaaagtatttagattctattgaaaaggagacagcaaatgaaacgtgaatcttatcaaacggagatgttcaattggtgtgaagccctgaaagatcagattcaaaagcgaggtcagcttgaccagtttgaagatcaaatcgacaagatgattgaggctctggaagatgaccaaactacagaagaagattggtataaacaggccgctgccctttatcgggatattacagaatcagatgatacaagtgaaagacgcgcttatgtccctatagggaaacacgtgctgccaaagcttccttacaaatactccgccttagaaccttatatttcacgcgatattatggtccttcatcatacaaaacatcatcaaagctatgtcgatggcctgaacaaagcagaatcagagcttaaaaaagcgagagcaacaaagaattatgacttaatcactcattgggaaagagagcttgcgttccatggagcaggccattatttgcacagtattttttggttttctatgcatccaaacggaaagcggcgtcctacaggagcattgttccaaatgatagacctttcatttggaagctattccgcttttaaagaacattttacccaagccgctaaaaaagtggaaggcgtcggctgggccattctggtctgggcacctcgatcaggacggctggagattttaacggcagaaaaacaccagctcttcagccaatgggatgtaatcccccttttaccgcttgacgtatgggagcatgcctactatttgcaatataaaaatgaccgggccagctatgtagaccactggtggaatgtcgtggattggcgcgaggcagaaaaacgttttgagcaggcaaaagaagtcgtttggaagctctattaaaaaaagccccctttcccgggggcttcgtgttttaaaaaatccctaccacatgcaaaaacacgatgataatggcaacaggagatagatatcgaatgagcagcagccaaacagcaaaccactttcgtttgagattggaaccgcttttcagctcgtcaaacaaatcctgtttcggtatttttagcgggacaaaaatcgaaatcagtaacgcacctaacggcattaaaatattgctcacaagatagtcggcggcatcaaaaatagacagatgaaatatagagacgtcacttaagacgccgtatgataatgcagacggcacaccgacaataaaaatagcaattccgcctaaccaagcgaatcgttttctcttattgacatcgcctttcgaaagtactgcgaccaaaatttccagcattgaaaaagcagatgtcaatgcagcaaataaaaatagaagtaaaaatgctaataaaaagataattccgaacggcatttgattaaacacagtcggcagcacgttaaataacagaaccgggccttggtctggtttgaggccgaatgaaaagacagctggaaaaatcgcaattccggccattacagcaacaagcatgttcataacagttacagatacagcggactgtaccagattttcctgtttctctaaataagcgctatacgttaccatgacagatacaccgacacttaataagaaaaaggattgtcccattgcatataaaatggtattggcatcaattgcagttaaatcaggcatcaggaaaaatttaattccttccatcgcgccatcaagtgtaaccgaacgcaccattaaaatgatgaataatagaaaaagcgctggcattaatacttggcttgctttttcaattccgctgcttaccccttttgcaacaactaaaattgttaccaccataaagagcagctggcctcccacagccaaataaggatttgaaatggtacttgcaaatatcgtatcaaaaccagatgtttgcgataaaccgccagtgaagccttttataatataaattaaaatccatccgcctacgacactgtagaaagatagaagaataaagcacgtcaccatgcctaaataaccgatccaatgccacttcgttcctggagcaagtgttttataggactgaacggcatctttctgtgttcttctacctatgatgaattcacctaacaataaaggcagtccgattaaaaccgtaaataaaataaaaataagtaaaaatgcgcctcctccactggttccggcaacatatgggaatttccatatcgcaccaagcccgatagctgatcctgccgcggctaaaataaagccgagcttcgaagaccattgatttgcttccttcaccgtatcactcctatttgatctaaccattataaaggttcattgtaagaatatcttcctatatagtcaagaacattttaattagtttacatcatatatctatagacatctgccaaaaactaatattgaattattcagaaaattatttataataagagaatgttatgaaatttgtaagaatttctgctgaagttcttgataagtgtgttaggagtgtttttatggacatcattagaaaaataagtcattttgcaggacaaacctttggcatatgggtcattgtttttgcagtgctgggattttctttcccatctttatttacgtggatcagttcttatattacgatttttcttggcattatcatgtttgggatgggccttacactgcaagccgatgatttcaaagagctggtcagaaagccttggcaagttattattggagtaatagctcagtatacgatcatgccgctcgttgctttcggcctcgcatttgggcttcatcttccagctgaaatcgcagttggtgttattcttgtcggctgctgtcccgggggaactgcatctaatgttatgacattcttagcaaaaggaaatactgccctttctgttgcggttacaaccatttctaccttattggcacctgttgtaacaccgttgttgattatgctgtttgccaaagaatggcttcctgtctcgccggggtctttgtttatctcaattttacaggcggttttatttccgatcattgcaggtctgattgtcaaaatgtttttcagaaaacaagtggcaaaagccgtacatgcccttccgcttgtttctgtcattggcatcgttgcgattgtctcagctgtcgtcagcggcaatcgggaaaatctgcttcaatcggggttgctcattttttcagttgttatcctgcataacggtatcggttatttacttggttttttttgtgcaaagcttttaaaaatggattacccgtctcaaaaagcgattgcaatcgaagtcggcatgcaaaactccgggcttggggctgcacttgccacggctcatttctcaccgctatcggccgtaccaagcgcaatattcagtgtgtggcataacctttcaggttctatgcttgcaacatattggtcaaaaaaagtgaaaaagaaacaagctggatccaaaagcagcaatctatcactttaaatatgcatcaaaaaaggtacatcactttatcgtgacgtacccttttttattatccttctaataaaagctgttcaggatcttccagtaaatttttgattgtcacgaggaagccaaccgcttctttaccgtctacaatccggtgatcataagataaagcgagatacatcatcggacggttttcgaaacgctcttcatcaattgctactgggcgcagctgaatcttatgcatgcccagtataccgacttgagggctgtttaagatcggagttgacatcagtgaaccgaaagtccctccgttggtaatcgtgaaggaacctccctgaagctcgctaagggttaatttattgtttcttgcttttttcgcaagctcgccgatctctttttcgattcctgcaaatgtcaggcggtccgcatctcgtactaccggtacgacaaggccttcatcagccgcaacagcgataccgatatcatagaatttcttaacgatcaactcatcgccctgaatttccgcattcaacagcggatattttttcaatgcagccacgaccgctttcgtgaagaaagacataaagccgagcttcacttcgttttgctcaaagaattgatctttgcggcgttttctgagattcataacagccgtcatgtccacttcattaaatgtagtcagcatcgccgatgtttgctgcacctctacaaggcgttttgcaatcgtttgtctgcggcgtgacattttttgcacttcgaccggtttatcaaagctttgctgtgcttttggagcctgaggctgctgcttttgctgaggagccggttttgatgccggtttttcgtacgcttcgacatcctgcttgcgcactcttccaagcggatctccagttggaacttgagacaggtcaattcctttttctctcgccagcttacgggccgacggagaagcgatcgttcttgattttgcttcagattgtgcttcctcgctcacctcttgtgcagctggttcagcctgtttctcttctttcacgctttccttgctttctgctttctctgtaggagcaggggcagaactttcacccgcgccttctgaaatcgtaccgataatttctccgacctggacggtatcacccgaatctttcaatacctcttgaagtacacccgattcttctgctgtcaattcaacattcactttatccgtttctagttcaagcagatattcaccctgttctacatagtcaccaggctgctttaaccattgggctattgttccttctgagattgattctgctaattcaggtaccttaatttccgccattttttcatttcccccttagtttttgcgagtcaagctatcagatacaatacgttcctgttcttttttatgaactgtcggatctccctctgcagggctggatcgtcttcttcgtccaatatattgaacgcttactccctctggtgcaatctctgtcaaatacgggctgatataaccccaagcccccatgttctgcggctcttcctgcacccaaacgatttctttcaggttcggaagttttgcaaataactctttgactccttttgccgggaatggatacaactgttcaattctcgcaatgtgaagccactctttaccgtcttctaacttattaaaatgatcactgatgtctatagacactttaccgctggataatacaagtctggttactttttcatagtcatgagaaagtcccgactgttcataaacaggctggaagcggctttcgctgagctcctgcacttctgacaccgtatttgggttgcgaagaaggctcttcggcgtcataatgacgagcggtctgatttcttcacgaagcagcattttagcctgtcttcttaaaatatggaaatactgtgccgcgcttgtcaggttggcaaccgtccagttgttttctgctgcaagctgcaagaatcgctcgattcttccgcttgagtgctcaggcccctgtccctcgtaaccgtgcggaagcagcatgactaatccggatttttggccccatttcgcgcgtccggcagaaataaattggtcaaaatacacttgagcagcgttggcaaaatctccgtactgtgcttcccacaaaacaagcgtttccggtgaatgcacgttatagccgtattcaaaaccgagaaccgatccttcagacagcgggctgttatgaacagcaaatgatgtgctgcagtcagataagtgatgaagcggcacaaattcttcgcccgtctcactgtcatgaagcacaaggtttctttgggcgaacgttccgcgctcggaatcctgtcctgttaaacgaatcggtgttccgtctttcaaaattgaagcaaacgcgagtgattctgccaaagaccattccacttttctgtcatcatcgaacgccttggcgcgtctttctaaaatgcgctttagcttgccgaaaacattaaatgactccggccagttgatcaattcgccattcagcttgcggagcacatcaaaatcaatcgaagtgtccacatctgggaaaccgtttgatacaggctctggaagttcaatttcacaggcagtgtgttcctttttagacggaactttctgatatgcatcttcaatgcgcttcgttaccgatttttcgatgttttgaacaacttcctcggtaagtacgccttcttttaccagcttttcagcgaaaatttgtttgacggtcggatgctttctgacagcatcatacagcattggctgagtggttgacggttcatccatttcgttgtgtccatagcgtctgtacccgatcaaatcaatcagaaaatccttgttgaatgtttttcggtattcgaccgcaaacttaacagctgaaagacaagcttcaggatcgtccgcattcacgtgaacaatcggaatttcataacccttggccaggtcgctggcatattttgtcgatctggattcagcgctttctgttgtaaatccgatcatgttattggcgataatatgaatcgcaccgcctacttgatacccttttaaagaacttaaattcaatgtttcagctacaattccttccccagggaatgcagcgtctccatggattaaaatggccagcgattttgtttcatcttgtaccgggtatccgctttgtgttcgcgtttcctgtgccgctcttgtgctgccttcaacaatcggattgataaattccaagtggctcgggttgttcgctaacgtaatgcgcgctgattttgtttcagcgtcttgaagctcccgattcgccccaaatggtatttgacatcccctgtccatccgtagctgattccaatggatccctcagacggtacaagatctttgttcggcgcatgctggaattcagagaagatgatttcatacggtttgccgagcacatgtgccaagacattcaggcgtcccctgtgcgccatcccgatgttgacacttgtcgtgcctgatttgacagattgtgcaataatgtcatcaagcactggaacaagagcgtccagaccctcaatggaaaagcgcttctgcccgacgaatgtgcggtgcaaaaactgctcaaagccctctacttcagtcagtctttccagcacagccgacagtttttcagctgagttcttctggaacagctcgccagattcaatctttcttgtcagccactcgcgctctttgaagtcatgcacatggtcaaattcaaaagagatggttcttttatacgtatttcgtaaatactgaatggcttctaaaccgttcgtaatgtttttaggagcgtctttgcagatgacagacgcaggtattgcttttatttcctcttctgttagcccgtaatcggataatggaaaaagttcgctctttttcccatcctttctgagcggattgacggaagcgttcaaatggccataggttcggatatcttctgcaagtctgactgcggatgcgatcttttgaatcagatcggctgtaacacgtcccttttcttttgttcccgaggcctcttttatatcgcttggcggagcaccgagctcgtcgaacatttccttcaaatccgggtcaatgctgttcggatcctgggtatactgatcgtaaagctccagcgcatagccgaggttcggaccgtaaaaatcttcccaattcattcgttgtttcatactattttgaaacatttgaatattacccccaacttaaataatcaagtgattgattcactatcttgaaataactttcgaacgctgtgtccaaaattatgtaataaaaacgcttccaacgatattttaccactgtttgcaatttgattctaccttgattgttcacaaaatagtaaaaaacctttataaaaaacaaaaaatttaatcattcgaaaaaacaaacgccaaaaagcataggattaagggctatcctatgcttttatgaagcagttttttcagcagcggatacaaaacatccggtagctgatcaacatccgggacaaatatactgaattttccgtacatatcctggatcgtcttcatttgcgattcttctatttctgagttggagagaaaaacatttatcacttctattcctctttttcgggcttcgataaccgcctcacttgtatcaacgatcccattttgttcgtagccaaatgcggccggctctccatctgagaaaacaattaagaacttttgcgcctcgctgcgatgcagcatttttttcgtcatctgcctaattgcgtacccgtcacggttatcttcttctggctcaagctgcataatggccggtccagactcttgtcttaatgatgattggaagggaataaccgtattgaaatagtttggctggcttgtttcggttgcatcatttgtgtcctcccagaacccgacaatctgatgcggaaccgctaccgatttcaacgcttcgtgaaacagcacgattcctcgttttgtttcgtccattttgtcgaacatgctggctgaacaatcgaccagcaatgtaaaaactgcgtcgatttctgaagatggttcttgctttttgtagaacaggcgcggatttcgctcagtgaagtagcgaagaagcttattgttcagtctcccggcatgaagatctgttctcggcaatgtttttttatgttcaagcgttttttgaatcatttgtttcaaacgcttttgatacgattcaatcgtttttgcctgctgtttataagaaagctcttcttcactggttgccggctgcggttctttataaattggaaatgcatatttattttctttgccgtcagccatccccgctccgttcggctggtctttttgggactccagcgcttccagcttggaatagtctttccgtttcgtttgtctggctgatccttgaacagagccaagggcctgatctccatcgtcgccttcccttgaagcatcttttcctaaatctgattttgcgccgtgttcaatatcaaattgaaggaagcttttggacggtgcttctgtttcccggtgccatgtcggcatttcttcttcatggatatcctcatcaccgtctgattgttttggaagcgtgatgtcatcactcagcttcggcgcttttttctcttcttcaaataacggctgttctgcagcttttgcgtagtcaagctcaggcaaaaagaagtaggtgttcaacatgtctttatcgagcacctcttcaagcccgtccatgaggtcctcaacaattttcagaacctgccgtgtcgaatctgcttcatacacacgcaagagctgctgctcaataaacgggcgcatcagatcgatatcttcacgcatggacggaagggtctcaagcggcgattccgctgtgagcttgacatagatcgcgcaaaagagcgcatcggtaaaaatgcttcgttccaaatttaaggtcagctgagttgagaaatgttttctgtacatgtcttttcgcttcgcaaatacatgtttcgtacccggacgctcatgtttgatgcgttcttcgattctaatgtcttcaagcagcataaagagctgcttggcaaaacttttaaacgtaagatggcgatggatatcattcaaaaagttcgcaaactcatgcagcgagctatatcttgttccgactgaacgcaggtagacgtcgcttttcagacccgcttccatgtcctcagctgccctgtctttccaaaagtggctcatatagattttcttttcaaatggattgtaataggactgaacgccatactccacttctaccgcttcactcttggtgagtgttttggccaaatcagtcagcatcataaataaaaatgaatcaattgtgctgtcgttaaatttgataaatttcatcgcagccccctcattcaaacagagtttccgcaatatttcggacggccgctttttcccgatcatcatcaagcttttctacaattccccgctcaatggcacgacgcggcggaatataagcagctaaatcacatgtatcgattaaagctctgatggatgccgcttcttcagacacctgtccgttattggcctgaacgatcaagtcagaggaaagcgtgataaatctgtcaatcaatttctcgtctttcaaggctgactgagacatgagcacttgtttcagcagctcgcctttaatataaggcacatcaatgatgacaaaacggtttttcaacgcttcattcagaggaacagttccgacatagccttcattgatggctgcaatgaccccgaaaccgcttttagcccgtatgacctcgcctgtaaacggatttgtcatcatttttctgtaatctaatacaccgtttaaaataggcagtgtttccggcttcgccatattgatttcatctatataaagaaaatgtccttccttcattgcctttgtaacaggtcctgaaacaaactcgattgttgcctggccagattgattttcaatcgttttataaccgaccaatgcctcagcgtccaagtcgactgaacagttgacgctgtgcatcggtttatgaaaatagctggacaatgtttctgccaactttgtttttcctgaacctgtaggccctttcagcaggacatttttccccatggctaatgcaataatggcgtcaaataaaatggcttcatcctccgcctcatagcctgatgttcctataagcgattgaaactctggggaaatgggctgctctttatatgataaaagcttttgttgtatatcttccggcaatgttaagtgctgtagttgtgttgtcatagacagattccctttcctattcatattccttaacgagtatactaaaaaagcccctgtatgctcaatacaaaagggcttggatgatattactgcttctcgttatttcccaaaagggctccgcagacaatacgcgcaccggaattgccgcttgggtttgtcagataatcgtccgcttgttcatgaataataaatgcacttccgtcctcgtcgagaatatttagtttacttccttttttcagtgaagtgtcaggcgcattcattatgacatctacctttccatcagcaccgacttcaaggttcggcagatctccggcatgatgccccatcggattattgaagccgtgttctttgttcagtggattaaagggaccgcccgctgattcaaaatccggcctgacacaagaacctttctcataaatatgaaaaccgagagaagcacctggacgcaggctgtttgcggaaatatgaatatcgaggccttcatcatctgattctttgatctctataaagccgactgctttcccttcacgattgaccaactggacatgatgaccaaacgctgacgtttcaaccacttttttttccggcaccctgttaggagggtctggaggttttttttgtccgcatccggcaactcccagtgccgtcagcatcatcaacagcaagagacggtacatactgtctcccccttgttttttctaacagtgtggtcaatcattgtctggtataaacaaaaaagcctataaaaggctttttgtcatactcatttttaaaaataacttcttgcgcccaagtaccgctgtttccaatacgaattgctgagattggaaatgtcgacgcccgatgagcttgcatgaataaaatcaccgccgcctagataaatccccatgtgagacgggccggatttatatgtggtaaagaagacaaagtctcctactgacggctggctgaccttctgcatgacattccaatatcctgccgtactcaatcttgatatagatgatacattattaatgaggtaataaatgaagccgctgcaatcaaaaccggcaggcgtgtttccgccccatcggtaaggcactccaacatattttttcgcttccgttatcattctgtcaatcttcgagcctatttgaatgtttgaccctgagttatcttttggctttgttggctttgtcggatttgaaggattagattttgatgctcccgaaatagtcagaacctgcccgatttgcaacacatccgatgataaattgtttttatcacggatgctttggacagtgactccgagccgatttgcaattttccacagcgaatcgcctgcttttaccttgtacgtcgttgtttttgagggattggagtttgacggctttttggaaccgctgtttccgttcttaggtgagctgcttccttttattttgagcacctgtttaggataaagtgtatctgatgttaagccatttaaggtttttaattcggctacagtcatatttaagctgtttgcgattttccacagtgagtcaccaagcttgaccgtatatgtactttttgaagaacctgaagaattggaaccgctgtttttctttgatccatttgatccgcttgaactgcttgtccctttgatcttaagcttttgccccggacgaatcaggtcactgctcaggctgtttaagcttttaagctcagaaacactcattttatgatttttagcaatcatccatagggaatcaccatatgcaactgtgtatgttgatgttttgcttgaattagatgaggatgtcgtgctttttttgctgctttcaggaaccttaagactttgtccgacataaagcaccgttgatttcaatttgttttcggatttcagagctgatattgtcgtatcatactggcgggaaagtttccaaagagagtcaccgctttttacttttatcgtttttgcttccgcgggtgctgcggccatcgacgacccaacaactgcagaaacagccaagccggctacaatcttctttttcattcattcaacctcctaaactgtttttttgcaaaaacagctagtatttcgtttccaaaaatggcacacaactgttttatcgtcaatttttcagcaagttaaacccttttcaaacatttggcgcagcattttcagcatcgttcgacctttaaaccttcaaataaacatctaacattttacataagcacgatatgtttttcgaaagtctaaggaactatttaagcgagggtaaaaatgatggttttctattgatgaacgaagcagtttctcctcctttcttgtctatttttctaatcaattctctatcggcatgtcaaatcccttcctctgcattcttatgaaatggcaaaaagcctgttctttcgataagaacaggcttttacactatgcatttgctgattgagttttttgttttacagcttcaagaatgctgtcggctgcttttttagagccgcctgccgctttcagtgattgtccaatttcttttgccttttcagcatacgaacgattattcattacttcttgtatcgtctctttcagtaggctttcagacaattcttcctttttaattacttttcctgcgccgactttttctacctgatctgcgacaacaaattggtcgcctcccatcggaatgacaacgagcggggtttcaaaatacaaaccttcacttgtgctgttcattccgccgtgggtcacaaataagctggctcttttcaagatctcaagctgagggacatacgggcgtacaatgaaattctccggaatgtcgtttaactcacttgttttaatatgcttgccgatggaaagcacaactttaccgtcaaagtccttacacacttcaaggcattgattaaaaaactgcttttgattgttaaaaatggttcccattgaaataaacagcacgttttcattgtcaatctgatcaaatgggaaatcattgtttccggctctttctgtaatggaaggaccgacaaatacatatcgctcgccaaattgctcatccagtggctgaaatccccttgatgtaaagatgattgtcaagtcaccatcagctaaaaaaacatcaaatggcttcttgatctctgcttgaaaatcagcatttaaagtttctgcaagctgctggtatgattcataatgaggcgaatcttcaagtgatcctttcatgtacgctcccatcatttccttagcaaattcctcattcatcgcaaaggttgtacacaatgaaaatcttggcagcttcagcatgttggcaatgactttacccgcgagaagatggtgatcatatatgacataatcatacgattcatgtttgacttcctcataaatatgagtcgcgatatccttacaggctttcaaaaaagcgcagagcatttctgtgaaatctctttcttcatcgccggttgcgtttttcccgaagtaatctcctctgaaatcatgatactcacgaaactctatatcaagagctgtgattttttctttatattccttcactgcgtagtacgtaatgttttctccccgggatttcagctccttcatcacaccgatagagggattaatatgcccttcaccggggaaaccgatcattaatacattagccatgcggcagcacccttcctttgaaaatttatgtaatattttatacggtactataaatacataaacaggtaaagtatttcacttaattaatattcattacatataacttttctaccagtttatatttcctgtcttcaagacaaaaagcattcagcttgaagcgaatgctttaataaagatgcgaattcagtcattttgtctcatgataggattcttaatcaggccctttttattatttttacgttcttggtgaaattaacggatataatacaccgtctttggcaaacgacatcttccctgtttcctctgaaaccacgagcaccagtgcatccgtatatcccgacataccgagagccgcccggtgccgggttcccaaatggatatccacttccttcgtcgtcagcgggagcacattggctgctgacacgagtttgttttccctcactaataaagcgccgtcatgaagagggtttccgggaaaaaagatgctttcaattaatgaagagctgatctcggcgtgtagggaggtgcctttttgaataaaatgttcaaccgggtctgctctttcaatcacaattaaagctccatgcttatgttccgataaggctttaatcgccttggccagctcaataaatgccggcgtaaattcctcaatgtatgattgcaaataaaaggaggatgcaatcccctgcatgtcctgaaaaatgtgccctaattcatctaattcacaaagaagacactggtctttttcgtgaagcgttttcaggattagagatgcatcacctaatatttgctctaggtacacctgtattttccccttgaacgcattttctgatatctgctcatagcgcataatcttcatctcctgttcaaatttccaacttttcacgaatgcttatcttattgatgcacattctattggtaaaggagggatgtaaagaatggaaatcgaaagaatcattcagtatatttgcacctttttaggcgtgatttcgctttcttttatttatgcccaaatgtttagaaaaacgaaaccgacaaaaaaagaataggcccggcgttcattgctttttatacataaaatgttataatttctctcgttatgaaaaagaaacggagatcaatgtatgaaagaaactcaaaatgcccgggaaaaaatcaaacagctcttgcacattttaataccgatattcattacccaggcggggctttctctaatgacttttctagatacggtgatgtcagggaaagtcagccccgctgatttagcgggtgtcgcgattggctcaagcctttggacccctgtttacacaggacttgcaggtatattaatggcggtcaccccgattgtcgctcagttattaggtgcagagaaaaaacagaagatcccctttactgttttacaggctgtatacgtggccgcgcttcttagcatcgccgttttagtgattggatatgctgcagttgaccttattcttggccgattgaaccttgatattcacgtgcatcagattgctaaacactttttaggctttttatcactgggaattttccctttatttgtttacaccgtgttgagatcattcatcgactcattaggaaaaacgagagtcaccatgatgattacactcagttctcttccaatcaattttgtattgaattatgtatttatcttcgggaagttcggaatgccggcacttgggggtgtaggcgcggggctggcatccgcgttaacttattggtgtatctgcatcatcagttttttcattattcataaaaacgcaccgttttctgaatacgggatttttcttaccatgtataagttctcttggaaagcatgcaaaaatttgctcaaaatcgggctgcctattgggttcgccgtgttttttgaaacgagcattttcgcagctgtcacgcttctaatgagccattttcatacagtgaccatcgcgtcccaccaggcagccatgaattttgcgtctcttttatatatgctgccgcttagcgtgtccatggctctaacaattgttgtcgggtttgaagctggtgcagcccgttttaaggatgcacgctcatatagcttaatcggcatcatgatggcgatcggcttttctttgttcactgccgcctttatccttttattcagagagcaaattgcgggcatgtacacttctgaccccgatgtgctccggctgacacagcactttttaatttatgcgctattttttcagctttccgatgctgttgccgcaccgatccagggagcactcagagggtacaaagatgtgaactatacgcttgcggccgcttttgtctcttactgggtcattggccttccggtcggttatatggtcggtacgtttacaagcctcggtgcattcggctattggattggattaatagcgggactcgccgccggagcagttgggctgtttttcaggctggcaaaactgcaaaaacgttattcgcaaaaacaacacatttaaaagaggtgatcaatcatggcaaaaaacaaaaaattattcgagtatctttcccagcatgcggaaaccatcagttcaacatggtatgaaacaatcgaggagactgatcccaattccatttatgcctcaacagaccctgttgtcattcacaatttaaagagccagaatcttgcctttaactataaaataaaccgtatttttatagatgatgaggacatatacttgcctatactgaaagaatgggcctttgaagtcacacaggatcaagagcatttaaaaactcctatccactatattattcgggagtttgtcagagtgagagatttatatgtttcttatgtgaaagaatttgtccatctcaatcaggatactgtgaaaagcgaagaagccgaagacctgtatcacgcccttataaaagcgtttgatcttgtgattcatatttttatagaagaaatgtacaaaaacacaagccttcagcttcaggcccaaaaagatatgattactgaattgagcgctccggtcatcgtgctgtttcacagcgtcggactgctgcctttaatcggagatattgatacagtccgcgccaagctgattatggaaaacacactgcatcaatgtgcgaaaaaaaaggtgacacaactgtatattgatttgtcaggagtagctgtgattgatacgatggttgcccatcagctgttcagtctgattgaggcgcttcgtttaatcggtgtttcttcaactttgtctggaatccgtccggaaatcgcgcaaacagcggttcagctaggtttgtctttcgaaggtatttccttgagatccactctcgcttcagcaattgcatcggacttaaaattaaaaaaggtataaggcttaaggccttatacctttttgattaatcattccattgatacgtccaatatatttcttcttcaaaccatgttgccataacaggttcattatttttcaatttctcttcaagctctctgagcatgccttctgtttgtgtgcggtgagctcttaacgcattcattttaatatcagctacttctttgatatcaagcacgacatcagcttcgccgagaacctcttctctgttgcgggtaatggccatgcagattgtacgcggacggtcttctttctttttgcggtacaatgcacggataaccgcttccccgcatgcatcatggtcagggtgcacaccgtgtccgggataaaatgtgacaattaaacttggttttacatcatctatgatctcttccatgatatcagctagatactcatcgtcttcaaattcgagcgttttgtcacggagtccaagcatacgaaggtcattgatatccatttctttgcaggcattgatgagctcttgttttcttaatagcggcaacgtttcacgattcgcgaaaaatggatcgcccatatttctgcccatttcacctaaagtggcgcaggcatacgtaacgggaatgtctttttttctgtttaaggcaatgaggcctgccactccatatgattcatcatcagggtgaggcaggattactagtacatgttctttcattattattcacccttttctttaaactgtgaacggtttttcgctgatttgcagagaaatagccagtttaccgcccggcagatgtcccgccattaataaacggttttcttcatctaccgtgtattcagtcaagccttcagcataaatccagccttcttctgttttcaagccaacgcggtaaggtccgttgcctttgatttttgcctgatgataagtgacttttgcattgcggatatacgcaacaaccgtcatgttcttttcatttaagtgcgctgaataagaacctgtggtggtttctaaatggatatatacagggcggtccgcatatcgttctaaagatgcttgcacatcttcttttatgatcgctttcatgattgctcccctctttcttcttttaaatactctgcacgttctgtatgtaatttgaccagctgatatttcacagccggttcgagctgtgaattcacaatgcgctgaatcgcggcaaaatatttttccagcatcggttttcggagtcttggatgtgttcgtttatccaagagctcaagatcaatcgcctctgctaccgcttctgcgtcatcatgtgcgagagatcggttattccaaagtgaagcataggctttcactatctctttatcattgtccatcgtcttgctcctttatgtcttacatacatgaaatgattatacataatatatgcatcagctgaaaagccaaaggcctcaatggctttttgacgcccgtttccacttcacttgtgaaaacgtaaacaagagcagcgcagcccatatacagctgaatgtaaaagccttcgagcttgaaaatggctcatggtaaacaaacagcccgatcagcagggtaatggtcggcgcaatatattgtaagataccgacttgatacagtggtagccgtttcgctccttccgcaaacaataagagcggcaaagccgtaaacacaccggccaaaaagagaagcagccacgtccctccgctttctgcacccgctggctgatcatgtccactgaacagcaaataccccaatgcaatgggcataatcatgaatgtttccagcgttaatccgatggcgctcggcaggcttgttctttttttgcttaacccgtacagcccaaagctgaatgcaagcagaagcgcaacataaggaatggagccgtattggaacgccgagatgatgacaccggctgccgcaatcgaaacggccactaattgcaggcgattcagcttttcctttaaaaataaaatcccaaggagcactgatacaagcggattaatgtaatagccaagactagcctcaagcaaaaagccatggttgacagcccatatgtatacaaaccagttgatcgaaatcaggatagaagcaagaaataaagagaggatccctccgttctttttcagagagcgcagctcctgccatcctattttccattgccgcaagaaaaaaagtacgatacacataaaaacaaaagaccatataatacgatgagccaaaatatcaagagccggcagctgttcgagaagcttccaatagagtggaaacaggccccacatgataaaggaaacggctgtgtaaataacgcctttttttgtttctgaatattgcatttatatccctgcctttctttagagcatcttatattatatcacgtgaaagatctggcgggcatatactattttgtccgtgaagaaaggatgtgaagacaatgtttgagtggaacaagtactttcctttccacaatcaattttctaaagaagcattaaaaaaagctgatccgaaagaagttgaaacgtatgtcaatcgtgtgatggaaagtgtgttcggcagtgattatgcggctcaatttcctttccgcgatcctctcccccaaaaagaacagcccgccaaacctgatgcaaaacctgatgtcaaacctgatattgatatattcgaaactgcagaccatgtgtttgtaaaggtgccaatcagcgaagaatggctggaacaagtgagaatcaaacacacatctcacgaattatggttggaaaacttcccaagagcagatcatccgaaaaaagtaaaccttccttgtttagtcaaacgcaaaggaacaaaagccgtctataaggatggccttctggaagtcatgtttcaaaagcagcaagactacaatatgtccgaggtagaaatcatccgataaaaaacggcctgcaatcgatgcaggccgtttttattaatagaagccgggatatcccccgtatggcacgccggcaccaaaaccgtacggtccgcctccatatccataagggccaggaggataggcatagggacgagaatagttaaacagcgcactcccgagaaaaccgcctaataaaccgccgactagaggagcgccaaacaaaaaaggactacgcgccggatatccggctggacctgggattccgcgtaaatacgaatgatgagggtacatgattttttcctcctttatgtctgcctatacgtaaagtattcagcaaggaagaaaaacgattgggctacggactgtctatgattgttacatcacaagccctgccaataacacacagccgagtcctgtaaccgaaagaactgttgtaagcaacgtccaggtttgaaatgtttctttcatgctcaagccgaaaaattcctttaccatccaaaatcctgcatcatttacatgacacgcaatgacactgccggctcctgttgcaagcaccattaacgcagggtttacactgccagcctccataagcggagctgccattcccgctgtggtaagcgcagccacggtagcagagcctagacacagacgcagaaccgcggcgatggtccatgcaacgaatagcggcgacatgtttgtttgacggaaaaaatcagcgacataatcgccgactccgccggcaatcagcacctgtttaaacgctcctccccctcctatgatgagcagcatcatcgcaatttgcgaaattgattctgaaatagatctgctgatttcctgcatagatattttacgggcatatcccatcgtatagagtgcaagcaacagcgaaatgagcattgccgttcccggagtgccgataaattctataatgtcttttccttttgaatgttcactcaataataaagaaaaaattgttgccattgccataaagataaccgggaataaagacgtgacagcactgatcgcaaagcccggtgtttcatccagctgaaattctttccttggtcctaaccccgataggtttccatgcttttgatacgcaccaggaaaccgtttcatcgcaaatttattaaataatggcccggcaatcacagttgtcggaacagcgatgatgattccaaaaagcagcacctggccaatatgggcaccgtatgcaactgagatagcagttggagcaggatgcgggggcaaaaatccgtgagtaacatttaaggcggcggccatcgggattcccagatacagaaaaggcatttttaattctttagcaatcgcgtaaacaatcggtatcaacagaacaagacccacttcaaaaaacagcgcaataccgatgataaaagaggcaactacaaccgccgcctgtattcgtttcctcccgaatttgtcaatcagcgtaatggcgatccgatagccgcccccagcatctgagacaagcctcccaagcatcgcgccaagtccaaacactaaagctaaatgccccagctgcccgccaattccagcctcaattgaaagaacaattttattgatatccattccaagtccgatggcaactaaaaatgaaacgacaatcagtgagacaaaggtatttaattttactttaataatgagaaataacagaatcagcactccgacagctacaattaaaatcggcatggtacccctccaaaagtgttttatatgattctcgcgacaatgttttggcgcttttcatgcctagatgaacagaaagcgctttcattaataactaaaaacgtcttggttatatgattgttatcttttgatcaactaatatgttcatactaatctcctaatcaatgactgtcaatcgtttttatgagcttgtctcgattacctaccacctaactcaatgatttattagttatatgttgattaacttttggttatatgttatgttttttaaagttgactgccaatcattatatctctccattgtctggaagcaaatgagacaatatgagaacagacggataacaacttcacaagaggaggagtacacatgccattattgcgttttgatgtaattgaaggccgtgacgaaaaatcgctgcaattgttattagatactgctcaccaagcgatggttgaagcgtttggtgttccggaaagagaccgttatcaaattgtccatcagcatcccgcaaacgagcttataatccaggatacgggattagggtttcagagaaccaaggatctggtcatcattagcatgacaagcaaagcaagaaccgaaagccaaaaggaaaaattgtatgctctgcttgctgaaaggttagaagaaaaatgcggaatttcccctgaagacctcatggtatctattactgagaatggtgacgcagactggagtttcggtctcggtgaggcgcaatttttgaatggaaaactataagatttcgtctccccataaaaaaaagagagagctccaaagaagctctctctttttttcataaatgcggaagtcatcagtatagaagcatccagcaatacgaaaaacctggatctccttttagattcggtttaaatgccaattggaagctgactttggccgaaaatataaaattttgctgatttgcataataagataactcataatccccatttacaacaggttggatgctataacttattgatcatttccatgaacatgacacttttgccaatccggaaatgtcagtctgacaaatataaaaagtcatgtaaacgggtgtgaaccgtacttacatgactcaccatggaaacaaaggctctttttcaggtgccgctttccttatttctcttcttcacacactgtgtcaccaggctcgcaaaattgatcggcccatgcctgcatttcttgaaatacagcttgaagcgctgttcctttttcagttagcgtgtagatgactttgaccggcgtttcagggagaacctgccgttcgacaatctcgttttgttcaagctccttcaagcgctctgccaacattttttggctgatcatcggtattgtttccgttatctctttaaaccgtttcggcccatccattagcacatggatgatcagaccgttccatcgttttcccagcaatgagaatgcggattccattttagggcacatcgtatttcccacaagtcttcatcccttcatctattgattgacatgtattcaatgatccattacaataatctttcaagttacatttagtaagcttctaacttttctattatcataccacgtttatccgaaggaggaaacactatgacgaatactctggatgttttaaaagcacgtgcatctgtaaaggaatatgatacaaatgccccgatctctaaggaggagctgactgagctattagaccttgccgctaaagcgccttctgcttggaaccttcagcattggcattttacagtattccacagcgatgaatcaaaagcggagcttcttcctgtagcgtataatcaaaaacaaatcgttgagtcttctgctgttgttgccattttaggcgatttaaaggcaaatgaaaacggtgaagaagtttatgctgaattagcaagccaaggctatattacggatgaaatcaaacaaacattgctcggccaaatcaacggtgcttaccaaagcgagcaattcgcacgtgattccgctttcttaaatgcttctttagctgctatgcagcttatgattgccgcaaaagcaaaaggttatgacacttgcgcaattggcggatttaacaaagagcagttccaaaagcaatttgatatcagtgagcgctatgttccggttatgcttatttcaatcggcaaagcagtgaagcctgcccatcaaagcaaccgcctgccactttcaaaagtatcaacttggctgtaaggatatgaaaaaccttagtccgaaatccggactaaggtttttttatacaatcgcctctttgtaccattcacgagcttgttcagcttcatgctgagtcagctgatggcccccgtcctgccagtaaacggaggctgatgccccgctgtcacgtaaatagcggtaaagctcttctgattcttccttcgtgcagagagggtcgtatttcccggcaccgataaaaacagggagccccgccatatcaggcagctcgatacctcgaatcggaaccattgggtgatgcagaatagccccttttaacacatctttataatgaaaaagcaggcttgccgcaatgtttgcgccgtttgaataaccgactgcaatcactcggccgcgattaaactgatgcgtttctgcagcctcgtcgataaaatctttcaattctcttgtccgcaccacaagatccttttcatcaaaaactccttcactcagacgtttgaaaaatcgcggcattccattttcaagcaccgatcctctgacaccaagcaaatgggcatcagggtctataaaccgccccaatgaaagcagatcgtgttcattaccgcccgtgccatgcaacagcaaaagtacgttgtcagatgttcctttttcataaatatgcttcattataaattccccctattaaagttcaggtaaaatgtctgtaatttgttgtctatgtttctccagccattcaggcagttttaaggaagtccctagctcagcaaacgtttcatctgtcataaagcctggttcatctgtggcaatttcaaataagataccgcctttctccctgaaataaactgatgtaaagtattccctgtcgagaatttctgacgaaggcagatggttttcagcaataatcggcagccatttcgcctgttcgtttttctttgtccgaaacgctacatggtgtaccgtaccataccctccgactcctcttttttcaggatgtaaatggacatcaatgacaccgccgacggccgctgaggatgccagtctgacaatctggtcttcttcggccactttggtgtatccaaagctttccgttaacaattgtatggtcgcctgcgggtcgtaggaatatagcagcacacctttcattcccgtaattgcttcatttgttgtgatcccgtcaggcgtccactcgcttttgccgcttttcgcatcctccatgatcgccagcggaaggtcttctgtatcatcaaaaataagacctttttcaccaaacaacgttttttcctctaggctcagcccgcttttctcaagacgctccttccaaaaaaacagggagcctgagggaactgaaaagtacacccggcccgcttggccttttcctaccgttccctgtccgcttccttggaacggaaaaaaggtcattattgtaccgggatctccgttttgattcccaaagtaaaaatgatacgttccgggatcatcaaagtttactgtttttttaacaagcctgagcccaagcacttctgtataaaatcgcaagttttcttgcggatctctggcgaatgctgtgacatggtgcaatccttctgttttcattttctcactcctatttatctcgatttcaagatatttattattttaaacctttattgaaaaggatgcaaaccatgtgttttgattaaataattgaaaaaatcatttttttctaataattatcttgtgatcttttcttacaactgctattatagtgagcattatcatgtttcaggaggaaagtaaatggttaaaaaagcacttattgttattctcattcttttgccattcgttcagctcgcgcttttgccgcttgtgaatcgaatagaaccgattatgttcggcctgccgtttttccacttttggctgctgctgtggattattgttacgccgttatgctcgtttggcatttatcagatgcaaaaaaaagatggaggacttgaataatgcaagggaatctgactgcacttctcattactgctattattgttttaaccgttgtctgtatcggctttcttgccggaagagacaaatcctcacgcacttctgtggaagaatggtctgtcggcggcagacgcttcggcggtcttctcgtctggtttttagtaggcgctgacctttatacggcctatactttcttagggttgaccagtactgcttttacaggcggaagtgttgcatttttcgccattccttattctgtgttggcctactttatcgcctacttcttcttgccaaaactttggaaagttgcgaaaattcataaattaacaacactcgcggattatgcccgggaacgttttaacagtaagcttttggcaagcctcgttgccatcgtcggggtactcatgcttattccgtacatatgccttcagctgagtggcattcaagacacgcttcaggttgccggcaccggatatattaaagaagcaacggttatcggattattagccggcctagcggtaacgtttattgtgtatatcactcaatccgcacatggcatttatgaaggattctggggattggccgccaacatgatcgctgtggttatcctgaatccgctgttcgttaaaaacgcgggatccaatcctgtcattgaaggtttatttggcaaaaaacaagacgctaatccaaatcaaaagggtgcataaaaaaaccatacgcggcagccgcgtatggttttttttacatttcttttttcagtgtttcaattgccttttccatttgcgtatcattatcagacagcttcttttgaagttctatcattaatttcgttgttgtatcgccagtcagtatgcctgtttcattcagcttctcttttttctggaactgtttgacgacagatacaaaatcctggtcatacgtactgttaacctttaccttgtaaccaagtgctttgagcattttctgagccactttgacgtttgtgcctgtatcacctgatttgtacgttttatctgcgtccaaatacggcagcttcgcgtaatcaggcagctctgctttcacttgaggcttgatgccttttttgtgaatccattcgccgtcagcagtcagccatttggcaactgtcagtttgacggtagagccatcatcatattcttttgccgtttgtactgtacctttgccgaatgtcgtctcgccgattaacggtacgtctgacgattcatgaagggcagcggccataatctcggctgcgcttgctgtaccgtcatttactaaaacgacggtcggcttggtcactttccgttctttttcggccttcatgacttcttttgaaccgtttttgtattcaacctgcatgatgtttttccctttatcaatgaacaggttgctcatcgtaatcgcctgttccattaagccgcccgggttgcctctcaaatctaaaatatagcctttggcgccttttttctctaaactgtcaatcgcatctgtcagctctttagctgttgtttcagagaaagaagtgatttgaatttctccgatgttgttgtctttcatctctgaatagacagtctctacaggaatggtatcgcgcttaatggaaagatcgatattccccactcccgctctgttcagttcaagcttcacctttgtgccctttttgcctcggattaaagcgacggcttcatttacattcatgccttttacgctttttccattcaccttaatgatttggtctctcggtttgataccggctttttcagcaggtgaacctttaattggggatacaataaggatttctccgtctttctcctctacttgggctccgattccttcaaaagatgctgaaatcgtctcgtcgaatgatttcgcttgctcttgatccatatatgtagagtacggatcatccagtgattgaatcattcctttaattgctccgtctactaatttgtcatcatctgttttttggtaataatcacttttgatttgctcatacgctttatttaatttgtcgaacttactgtctcctgtgcttgctgatttttggcccaggatactggaattgcccgtaataaataaagtaagcgccgaagcgacaactgcagtgatcagcacaataaaaaacagttttaattgccgtttcaattaaacaccacctttttcttcttacattattatcatggacgaattcttattcgtcaactcggagcagaaatgaaagagaaacgcccttcttttgcttttcataaacctatgtctttatacgacatatgataaggaaaaaggaggattcgatattgagccgatatttagaaatgctgtccttattcggtgtcgcaggggcgcacccaggcgggctggctttttcaaaagcggtcttgcaaaaggctgcgccctccccggatcagccgattcttgatgccggatgcggaacagggcaaacggcggcttatttaggacatttgctgtatcctgtaacagtcgttgataaagatcctattatgcttgagaaagcgaaaaaaagatttgcgaatgaagggcttgccatccctgcatatcaggcggagctggaacatctcccgttttcttctgagtccttttcctgcgtcctgtcagaatcggtcctcagtttttcacgcctgacatcctctcttcaagaaatttcaagagttttaaaacccggcgggatgctgattggtatcgaagctgctttaaaaaaaccgatgccccctgcagaaaagaagcaaatgatggatttttacggatttacttgcttacatgaagaaagcgaatggcataaactcctaagatcctatggctttcaaaaaacagaagcgatgacacttcttccggaagacatggaatttgaaccaaccacagaaatggatttatcgcaaacgattgatcccatctattacgatacgcttcaaacacattatcagctcatgcagttatatagtgagtacatgggtcattgtatttttatcgcgtacaagtaaaacggcgtatcgccccctgttttcgtccaacctttttttcctatctatcatatgctgatagaaagtcaggataggaggggaacaatattggagagatattatcatctttgcaaaaaccatcaaggtaaagtcgtcagaattacagagagaggcgggagagttcacgtcggcagaattacccgtgtaacaagagacagagtttttatagctccgaccggcggagggccaagaggtttcggttacggatattggggcggttattggggatacggagcagcttacggtatttccctcggtttaattacaggggtcgctcttgctggtttattcttctggtaagcatagaacaaatgctagattcaccagacacaatgaagcccgcttatctagtgtaagcgggcttttcattttaaattttcttcactttttcaaagtactcttcaagcgttaaatcattatcttggatgacctttgcggcttttttgcctacatagcgcagatgccatggctcatattcatatttcgtgatatcttctttatttttcggatagcgaatgataaagccatatttataagcattgtcctgcacccatttcccgtctgccgtgcttccgaacgcttcatttagctcaaagccattgctccggctcgaaatgtccatcgcgaggcctgtttggtgctcgctttcacccgggtaagcaaccgcttcctttgccttcttttccccttttaggcttacttcattgtcaaaaatgactttctgtctgtcatacgaacggtaccctgagacagctgccagttcatagccttcctttttggcagcatcgaacattgtttttaatgcgtcggccgcttcttttctgatgtaacgtttttgaatcttttcttcaaaagaaaactctacatctggtatgacaagatcgctaggttcatagtttccgggcagtgcatattgtttattgacaagcgcgagtatattttctggattttgaatggtttccagaccatcgacttttttaatatcattgaaatactggctttccaaggaaaactcactgttttgagtgtttgattttttgctgtcagctgttttttgttctgtttgctttgtttctgctgtggttttcgtatccttttgagcatctccgttcgacatgctgcagccggctccgactattgccgttacactcagagcggcagccagtgagaaccatttacctgactttttcatattacattaccttccttttatcaatcgtttccgcattcataaagaagaggctgccggcacccagcacgcctcttgatatattttattgtgatacggaatgtaaagccacttctatcatatcatgaaatgtcgtttgacgctcttccgctgtcgtttcttctcctgttaatacgtgatcactcacggtgagaattgacagggcttttcttccgtgcttcgctgctaatgtatacaatgcagttgtttccatttcaacgccaagcacaccgtattttgcaagtttttcaatttgtgaatcgtcgttgtagaactggtcagctgtaaatacgcttcctacagtcaccggcacacctttatcctttgaggcatcataggcattttttaaaagctcgaaatctgcgcaaggcgcaaaatcaatgcttccaaaagcgactctgttcatttgtgaatcagttgaggaggtcatcgccaaaatgacgtctcgcactttgacatctttacgaatagcgccgcaagaaccgactcttattagattttgcacatcgtagctttgaattaattcattcacataaattgaaatagacggaacacccattcccgtgccttgtactgagatttttttacctttatatgtacccgtaaatccatacatgcctctgacttcattgtagcattctacattttcaagatacgtttctgcaataaattttgctctgagaggatctcccggcaaaagcactgtatccgcaatttgtcctttttcagcacctatatgtacactcatctcatatcctcctgtaaatcaaaattatcatccagcccgtccattttacaacgaatgtcatgatgaaacaaacttcagcattgattataaaggaatatgtcgaaaaaagaaatgttcgaggatctgttaggcacttcctcagaaaaacggataatcggggtgttaatttgaaaacctaaccgcaggaaggaggggtgggacatgggtaaaaaacatcgtaaccggatcaccggccaaaaaaagaacaatcatatacctgaaaaagatatcattgcagctgaagaagcacacgggaaagaatattctgctgccaaacgcaagccttaaaactgcagaaaactgcgggtttccgcagttttcttttcattatgtcgtttgtacaatcagacgattgattttcctccagccggcgggaagcagttgataatatgttttcccttttctgccttcatcaatcaggatcacgtcccctgtggccatgaatcttgcatcataatcactcggaacagtgtcgaatacattaaacaaagagaatgctcttttcagcacgtcttgatgatcgctcccgttcagttcagttcgatagacggctctgtagccctttttttcgccaaaccggggtgtctgaaatattgtcacgtcataggaacaagacttctttttaaacacggataacatcatcaagatcccctcccttttatttctttaacatattggcgtttttgctgtgttttcctctctctatttttgtcgaaaccgcttaatcttttcgtcaaaaccttttactaggaaaaacagaagcaagccgaggctaaagcctcctaacacgtctgtcacaaaatgaacccccagatacactctgcttatgccgactaaaacagcaattacaccggctatgatatataccatttttttatgcttggacaaaaacgggaggtgtttcactaaaaagtaagcaataacaggatagacacaagcagcattcatggaatggccgctcggaaaactgaaggatgattcatgaaccagcggtgcaaaatcaggcctcactctttcgatccattcttttaagactttgtttaacagccgatctgtgccgaatatcaagagcatcaacaggccgtcccatgtttttctgtagaaaaacaggcctgctccaatgatgacaattagagggagcagaaaagaagaagcaccaagatgcgtgatccccgtcatgacttcattaagccatggctgacggatcaaaacagctgccttgcttattgcttcatctgcagattgaacagcatttgtatgaatggccgcagctagaatgagaaagaaaagaaacaaactaacgggcttgtacaattttaaccacctcaattttcacagaagtcatagaacatgaataataaaaccggagctgaccgctccggttttaagcctcactcatcttcatccagctcttcatctatcatacatttttctatcaaataatcaaaggtaatatcagcgatttcaaacagctcatcctcactcggtatgtagccccgtcttgcaagctctctgtaaaaaaattcagcgatttcttccgtatcaatcacaagatctatttctttcatctccgtaccgcctccttttttatgttttatgaaaaaacaggctgaattatacccggtgttctaaacaattctttcagtcatatattgaataaaaaacgagccatgggaggctgacgctatgattgctaaaatgatggaagcactggacggagaaagatttgatatcataatggaaaaaacgctcaaaggaatgacgcgtgtgatgatttggggctgtctgccatattttttatatgtcttgatccgtatgttcacaaactaactgaaatgctcttttaaactttccaaaacaaacatcatcatgtctttatattcttcatcatgaaacatttcgtacagaattttgtagtcattataaatatccagaagctcatcaacaattgacacagcaaggatgtgaagggtatcttgatcttcatcatcgccttcaaactgaagaagagcagacgatgcgatatcttcgccgatctcatggccagtttctccgacataatggacaaacaacagctgatgcacaaactggtccatttcatattttctaagcaccagcgtgagatcctcttcctccgtttcaagccactctccatcctttaaacgggtcagctcataaatgatatcttcccagccatcttctaaatatctccaaatttctgttctatggccgataatgcgaaagagttcttttccataatcttttacataaacaacgtccccaataaggaattcatattcaatatcaagcttctccatgtcgacaatgacaccctcataatctttataaagctgaatagatgattcaaagtataaaacttcgttatgattgacttcataaagatagtgtttatcaatttggtgtacttttgtgatggtgccgactgttccatacataatgacgactacgatatcccctacttggaatttcggtttgttttgcttcatggtgtctcccctcgccgcaacatttctcatacgctatcgtatgccgggtgaagccaattcgcatgggcatgaaaaccaaaggaaatatccaattatggtatgggtatggacataaaaaaatccgcagtgatctgcggatgaaacagctattatctgccgtgcacttcagactcgtattgatcccaagcttcatcaaacgtcgccatcgtgtgaaggtaatcagcattcagctccaaatatgaactgatttcatgataatcggttgatgtttttggaaagctgtgatcctcatacgcctgattggcaaattcactgatgctgtccttcggcttagggtgtctgtatttcaataaatagtgataaaaggatttcatgggtttcccctcctggtgtctgtcttttgttgttctattatacagttcaagtgtaaaattacaacaaaagaatactgaaacatgactcaggagaagtcaaaatagttgcgtttcaaaattctttctgtctccatgatctgctgatatgtcaggctttcaagcagtttttttgtttgaattaaaagaagctgatcctcaatctccttaaccgtgttttcctcttgataggtcataccgcaggaagaacataccatggcaggagtgtctgtcagttctatagccctcgttccatcaggaagctcccagtacaccgtgttcctgccgggcactgcttcaagctcgccgcaccattcgcatgttttcatgaagaatcccctccgcattcagtctctttctgctttttctgctgcgccaaaaatttcttttctttgagctgatctcttttctcacgacggtcttttaatgtttcatgctccggatttgcgatgtatgcctctctccttttgattctgtctacattttcaggtgtaaacgaaacttctttgtcagcaaaaatggcactcagcccgatcggctcctttttgtcagcggtttcaggaaaaacggactcaaaataggcgtctgcctgattggggatataattctctggttccggatatgacgtaatcacaccttcaaaatttcttaagatcactttgtcaggactttgtgacaggacatagtttggctgcagggcgattttacctcctccgcctggtgcgtcaacgacaaaggtaggaaccgcatagcctgaggtatgacctctcagcccttcaatgatctccaaacctttggaaacaggagctctgaaatgcccgattccctctgacagatcacattggtaaatataataaggacggactctgatttttaccaagtcatgcatgagctttttcataattggaaccgaatcattaatacctgctaatacgacagcctgatttccgaccggcactcccgcgttcaccagcttttcacatgcctcaacggattcttctgtcatttcgatgcttgtgttaaaatgggtattcagccagaccggatgatattttttcaatatctcgcacagatgatcggtaatgcgctgcggaaagacaacgggcgctcttgttccgattctgatgacttccagatgcggaatgctgcgcagctcttttaaaatatattctaaaatttggtcgttgatgagcagcccatcaccgcctgaaattaaacaatcgcggatttcgggtgtttcccggatataagcaattgcagcatcaagctgttttttggggacgcccattccgatttgtccggaaaagcgccttcttgtgcagtagcggcagtacatggaacattgattcgtgacaagaaacagcacacggtcgggatagcggtgtgtcagaccgggtaccggtgaatcttcatcctcatgaagcgggtcttccagatcgtattttgttttgtgcatttcttcagaaagcggcacagactgcatgcgtaccgggcatctcggattgtcggggtccattaaagaagcatagtaaggtgtaatatttaaggggatcgttttggtagaaattctgacgccttcctcttcatcctcggtcagattgatgactttctttaaatcatctaacgttcttacagtgtgtgtcagctgccaaagccaatcgttccatttctcttccggaacgtccttccataactcgatctccttccaatgccgtttcggtttataccatttgtttttcaaacgaactcctcctcgcgcatattttgacttacagttgcttgcaccaaatattcatgttttcaaggccttcggctataaagcaattattgatcagccttccgccatactgataacctgaatggtacaacacagcattcatcccaaaagacgaagcacgggcgagagaaaatacatgaaagatatcctttccagccatttctttttctaacgcctcgattaaaaagcttgttaacgaatggccgcgatattccggcagcacagcgcaatcggttatttctgcatgcccaagctctggattgatttctgcgcttgctgcgctgatcaggcggtcatgatcaagcatgatataatacaccgtatttgcattcatcgtcttttcaatataagcggggtcaaataccggtgttgggtacgtgcggaatacttttttatacagcatcgatagctggtacatgtcgtttgtttctgcttttctcatcgtaaaaacgggtgtactgtcgttgcgaagacggggcgctgtgcgatatatggcttcgatgatctcctgttcctctgtataagaatctgtttgtctccggctttctgaaaggtaacgtaccatgacacaagccgaatagccgagataatagccctttagatagccctccggcgcaaataattgtttggcaaggatcggctcatcatgctgcttcgcatagacgatgattttttctgcattctcttcttttgccgctgccacgatatccggcagggccttctcaatagctccgtcataacggaccactctgattcgtttattaaagccgtcatggtccaaaactgctgtgacaccgctactctttattgacttgagcatccgcatcctccccatctgtatgaagcccgcaccaatccatgacaaaaagtgcaataattttagcagattctatcatggcttcaacctcaatgtattcattggcctgatgagccgtttttgtttcccccggcccgaaaacgatcactggtgtatctcctgcatggtacaaaagccctccatccgttccccacggggaagcctcaataatcggctctgtctgtttcattttttgataggctgattgcagcacagaaattaaagggtgatcatcaggtaaatcattcggcagccattgagcgccaaaccattcgacttgtacgggatggcgtttaaaccattcgtcatagtattctaaatccttcagccagttttccaattcaagttttacagcttctggtttctcatggggagcaattccgcatctcccttctatgacgacacggtctgcaactgaagatggccaggcaccgcccgagatggtgccgatattcaccggtaccggtattgggatattgtcatacagcggatctgaaattctcgcattgcggactttctccagctcttgtatcgctgtgataacgtgcatgcttttttcaatcgcgcttaccccttcgtagcgtgtgcccccatgtgcggataatcccttcacagtgatccgaaaccacatcgaaccctgctgcttaataaatagtttcatatttgtcggttcaggaatcagcgccccgtcagcacgatagcctctcatgatggcggacagtgtaccggcgccgccgcactcttcatctacaacactctgaaacaatacatctcccttcagtttgacatcgcaggcgtgcagggcttctaaagcaaaaagaagggctgtattgcctcccttcatatccgttgagccgcggccgtatattttaccgttttcttcgacagcttgatacggttcatacttccaatcctttacgcttccttcaggcacaacatcgatatgaccgttcaaaatcagggacctgcctccgccggctcccgtttttttagccacgatattcgggctctcatgaaaatcggatcggttagatttaaagtagggatgctgttttaattgctttatgcttggctcccatacatcaatgtccatctgaaattgccgcagcttttcaagcacaacagcttgggcgttaaactctgaccccaatgtgcttttttccccaatcagccttttgagaagacgaatggctttggccgaatgctgaccaagccacccgattacttttctttcaatgtcttgcatcctcattccccctcttaagaaaaagacatatctattttgatttcagcttctgtcagcctcgtcacctcatcgattgtcgagccattcatcagctcttttaaaatgaagtgatggctatcgacctcaagaaccgctttttcggtaataatcaaatctacacagcctgcagcagttaatggcagcgtacatctttctgttaatttaggccttcccttttgatctgtatgactcatgacgacaaccacttttttcgctttttgggcaagctccatcgccccgcccataccaggcaccttttttcccggaacaagccaatttgccaaatctcctgattggctcacctgcagggcgcctaaaatcgtaatatcaattttgccttttctgatcatcgcaaaagacatggttgtatcaaaataagacgccccttttacagcgcggacaggatagcccgcggcgttgcataaatgcgcatcctcttctcccttttcgggactttctccaatgccaaggacaccgttttccgcttgaaacatgacctgcatgtcaggcggcaaaaagttcggtaccaaggatgggataccgataccgagattcacaatcatgccctgcttaatttcagtagcagcccgttttgcaatctgttctctttctgctactcccaagcccatttccacttcactccctcgcttcgtacaactccctcaacaaaaacccccggtgtgacaatcatttcttcagaaatctcacccatcggaacgatacgctcagcttcggcaaaggttctcctggcggccattgccataagcggattcatattgcgcgcggttttgtcatacgttagattgccgaattcatctgcaatgtaagcattgatgaaagcaaaatcagccgtcagcgcctcttcaatcaagtatcgttttcccgccactgttacgatgtcctttttttcgcaaaccatttgattatcaatgcccacatcggttaaaataccgccaagccccgctccgccggcgcgaatccgttccgcaagcgttccctgaggtgaaaattgaacctctaacgtcccctctgtcatctgttttccggctacaggattggaaccgatatgcgaggcgatcagggttttgacccgttgattaacaataagcgggccgatcccgatatccgggaaaccggcgtcattgcaaatcacagttaaatccgttacaccgctgtccaatatcgcttcaatcaatgaaggaggcgacccgactcccccaaaaccgccaaacatcagaaccgatccatcccgaacatctgcaattgctgtgtcaatgctgattgctttttgaaatggcgccatttaatgtcaatccttttttaagtttttttcgaccgctgcaactgtttctgaaaaaatagagataagctcttccacttcaccgtctgaaatagtaaaaggaggagcaataatgacagcatctccttctccactgtctattccagctttggaaggataaacaatcagcccgcattttttcgcctcgctgacaataagctgggttaccgcctgctcttgcggaaacactttcttcgttttttggtctgccacaaattcaacgcctaatagcagtccttttccgcgcacatcacctataatgccgctttgagatgccgcctcatcaagctttttcttcagcacagcgccctttttttctgattgtttgatcaagccgtgctttaacacatatcgcaaaacttcaagagcagctttggctgaatagggatgtgcactatatgtgtgaccgctcataatcacacctgacccttgttttatcgtttcaataatagaatcagatacgacggcagcagcaataggcgcataccccgcaccgagtcccttccccagtacagcaatatcaggtacggtgtcccaatgctctgtcgcgagcatccttcctgttctcccaagccccgtcatcacttcatctgcaataaaaagcacatcgtgtgtgcggcatacctcacttaatctctcataatatcccggaggcggagtaatcgctgctcctgcagcaccaataataggctcagccacaaagccggcgatgaattggcttccgattcttttgatcatagtgtccagttcatcagctgcagtctgaacaaagtcttcttctgtctcgtgattcagccgataaatatgtggagctgagatagctggataccgctcaatgagatgggtgaaccggtatctcctttcataaaaaccagacaatgaaagcgctcccaaagttattccgtggtaactgctccatcgagacaaaaagatggatttttgtgtttgctttttttcctgccaatactgaatggcgattttcatagctgtttctatcgcttctgatccgctgttgacaaaaaaagaccaattcacatctccgggcagctcctgtgccaagagagcggctaattgctcggcgggctcactcgtaaactgtgagcggtaagcaaaagacacctgatcaagctgttctttcagcttctcagtcacatcacgaactccgtggccgatattacatgtcaccgcacctgacgagccgtcgagatatttttttccggtctgatcataaacatatgaacccttcgcataactgacaaccggataggccgagctaagttctggcttaatcaaataactgctcatgctcccacctcaaaaccccttttaccatattgtatgagtgtccaaatggcggcatgacgttccccgcaaaaactttttcacataaaaagagccttcctaatagggaaggctcttttggaatttcagcatctagcaaataaaagcggctccaacaataattaataaaatgaacaagacaacaattaacacaaatgtatttgtcccgcagccaaatccgtaaccgtacccagagtatccatacatgctgttttcatcctttcttatcacgatatacggcattttatgcgggccaagtcccaaatggtttgtgcaaacgcctatttcatgtaaggaaataatgaaatacagtatgcacccgctcatattttttaaacgtcagcttttcgtaaaactgagttgcaccgtcagtgcttgcagcaactaagtaggctgcttccattcctagtgatttggcgatggacagcatttctttcactaagatactgccgtagcccttcctttgaaactgatctaaaattgccacttcttcgattttagccgttttctcttgatgatcgataaacagctcgccgcacccaatgggaactttctgtgcctggtcgctgtaacaaacaacaagaatgattatacctgcttcatagaaaggatattttctttttaatttttgttcagcgattgcttctccaatataaatggaatcgtaaattttcataatagaagatccgtcgctaagacttttcgccgtcccccatgcggttaaaggatgtcccatctgccccttccagtcactaagcttcatgtcatatagtagctcatcctcgacgacaaaaccgctttttacaagcgactgcttcaagccgagcggaaaaacatgctgcggcgacgcttttaaatggagataattcgcatcaagcagctttggtacggagggtaaaaagttaagtaaccgctccaatggaaacgtatcatgaagctgaacaaagttatgagaaaaaatttgtggaagctgcggatctctgtatacgctgtaatgatcaaacgatgccgattcagacgttaacaatatatattgatgttccgtttttgaataatgtcctgtcatgaacgtctcctttttatgacctatacctttactctgttgcaatattcaatttctttataatctcatcgtacaccggataaaacggctttccaattggaaattgctgaatatttcggaaagaagcggagattggcttctgatgtaaaaaaaacttccttgctacttgttcactaatcgggtgaaagacgccgtttagaaacaaaaacggctcgcgttcgatgaaaaacacccgtcggccaggcggatttatgatcaattcagatcgtttccacgtaatcggcggtccttccggaagcatctccatctcttcttttccaattgtcactatgtcttttctttgaaattgataaaattgaaacgcatactggtccacaattcgccttttttttccggcttcgatataaaatattgcaggatggtcagcttcctttactaaaatataattcggaatgtttaaaattttgccaatcctatattggaataaatatgggtctggaacagcgacagtccgatttagatacaaaaaaccccacttttctccaacaggatgccttacaccctgatcaaaaaaatacacattttgatctgaaccttttacaaaagagccgtcaatcaaatcggcgggcagaaaccgatatgcattttgaaatgaatctggggttttataggttgtgtctaatacttcatttatcggcagaaatggggtaaagttgttgagtctcgcccaaaaaattgcgtcgccatgattccaatgcttcatatcatcatcccagtagcctccaaatttatggtggatgagattaagtaacgaacggcgatgcataacggagcaatgatcaacttgaaaagcggcctgatcaagcactgcattggcatttctgtagaaatgtgagatttcctctcccctttcgtttacatgtactactttttgttttgaatagaccgcctgcgcttcaggcttatgtgaaaactcttgcaccatacggctcagccgctcaggatgataaacagtgtcgtcagtaagataggaaatgtaatcgccgtctgcaaatgggagcgcactgttaattaatgtggcataacgggctgtttttaatcgatctgcaggatacacgaaactgttatgatattgaatgcgccggtcatagagatacttgtgaatcaccgcagttgtttctgcattcgaatgatcatccatgataaaaagctcccaaagatcatgcgtttgctgtatcacgctttcgatcgctttttgcaaataatcgggtttgttgtaacttgttaaaataatagacactttctctcccatctataccgcctcccgccgtcaaacataaaaacggctccgcagcaagcagagcctctgtcatcatttaaaaagcaccccagcttacaacacttgagagtgaaacatgagatctcgtgttatttaacgggttttggaaaataaccaaatcagtcagaacttcttttacgatgacattttgaagtgtatctccgttgatcaaattgacttttgaaaccggtacgcccagctcttttgcaaaaacaagctggcgtctgaggtcagatggatttccttcagaagacgattgacgtataagcagaatcagcaaaagcaaaataaaatgcagatcatcttggttttcttctcgatccacttgtttctctaaatccaaatcatccctctcccttatccttatctctgtttcacaatatgtgcgacttcgatttatggtataggctatgtccactccattaaaaaatcagcattttccttaaatagatgaaaaatagatcaggtacggcgttcgactcataccaaataacagccggaagaatatgaataacgtgagttcactatcgaataggaggtgtgtgtaatgagctctgaaaatgcacagttaaaaaaggatttaattaaagccgttttaagccctttatttccaactgcaacagaaggaggagaaaatatggatagtaatcttaaagccttgcttgatgctgccatcgatcaaaaagtagatgaaagtgaaacggttacggcagaatctattttagacccttctcttccggcaagatggatttttgccagaattacgccaggcacgacaatcagcattgtaaccgattcgggagacatgatcgggccggttgtcttcgttgctttcgatcaggttcacgggatcgtctttgtaacacaggaaagttccgtcactccagcaggccaagctacaacattaattgatgtagacaaagtagaaagcgttacgtttttttcataacatccgatgaaagtgttgtatatccagtcgggatacggaggaatatacagttattttgatcgctgggctgaagaatgttttcagaacactcatacagagtatatgattgcagataaacctgaagcagaatctttgatgaagatcgaagcgtttcagccggacttcacacttatgatggttggagaccgcgttcctcacgactggctgacctggttaaagggtaaggatatccccgtgtatgtttggctgaccgaagacccattttatatggatatcagccttcaggtaattaagcttgctgacgccatattaacgatagaacaaaatgcagctctctactatcaagagctcggctaccagaacgtctattatgttccgataccagttaaccatcggctgtttaaaaaaatgggcaccgaacattcctatcattcaaatctgttaatcatcggctatccttaccctaatcgggttcagcttatgaaagaagcggtccatctgccattcacggttcgggtaatcggtaaggaatggggaaaatatctgcctaaaaaagtgctcaaacagccgcatattgatgtcgtcagcacatgggttccacccgaacaggccgttcattattataatggggcagacatcgtaattaatgcgcatcgtccctatcattttgctttcaaccaaaatactatgcgcatcaaaaatgccagttttaataaccgaacgtttgatatcgctgcatgcgaagcatttcaattaacagatttacccgcggcgcatcctttttcatcctttatttcttatcacggcatgaacgactttaaggaaaaagccgctttctatatcaaccaccctgaagaacggcaaaaagctgcagcagccaattataaagagatcgtacccgcatttacgtttgatgagcttcctgcaaaactaaaagcgattcatctggcgctctcatgaaaaatcgttcattgctatgaacgatttttttattaatagaaaaaagcagctgcacaagctgctttcaattctagccgtcagaacggtctttcagcttcctcggatttacctgtttatgaagatcaggcatttcgccgagatgctgtgcaatttgttcccacgatacaattttgaaattttgattgacggcttgtccgttatcgatattttcgccatcctgcgccacaaaaatcccgtacggatattttgggccaagtccgaaaccgagaacatcaataccatccgtgtcactagtaccgtctatcttctcgccatctgtaatctcaaaattggctacataacgatttttcccctgccgttcatacattgcatagctgttatttccttgacttgaagccatgagatatcctttgccatttggtgcataatagattgtcagtccttcaatatcagctgtcaaatgatctcctgtcgcacggtcaactacctgcccctttgatcctccgccgggctcagcgttaaatttccagatggcctcatcttcctctgctatgtataggtttccgtactcatcatccgcaacaaggccttcggtctgagtattcaacttaaattcacgcacctttttccctgttacataaccctttccaccatcaacaatttcatactgctcaaattccccttgtttgcctgtcactaatgcgtaaaatgctcctgttttctggctgtgatacaagctgaatccataaacctcagaaatattggtggaaataggatgtttcggatctgtaatgcttttcaattttcctttatccccatctattgcatatacttcaattgtattttttccttcggaccgattggatgcggcagcaatatcaattttttcgccgttcaatggaaaatcatagcgcagatcgacattattgagcttgccaaactcataagaatgaagctgttttccgtctaaatcatacacgacgagccctgacttcttatttgtcgtaatcaacttgcttttttccgggtgtttttcatgaacccaaatggccgggtcatctgctgcgtcatcgccagatgcgaccggatctgtctccgtgtgtgcagtcactttgaaatgatgttcctcattcacataatgagccgacacagaggttgctgtcaggctaagcaataaacccgcggcagtgcttagcagcattgtttttgaaaccttcatttggtaccctcctcttttatcactatcactactattgtaaaatatatacaggtgattaccgtgaggaaaatgaacctttttttatagggtttctgactcataaacaacttttccccaaagaggtacgtgagatggactttgccagatttccttttgcggagcgaaataaaaatatgttgaatatttagtacattgtttatttaggtttgttgttccctagttacgtccgtttttccattttctattaaaaaagaacactttgtgacatgatcattcccctaaattttgttttattggttgctttcattaattcgattacaaagttgaacatatgatgcatggtagagaaacgagagttggaggataagccatgcctaaacagcaaacagcagaactaaaaccatttttccataacaaaacagttttagtcactggcggaacgggttcaatcgggagtcaaattgtcaaacgccttttgctgcttacacctaaacaggtgattgtattcagcaaagacgacagtaaacagtatgtcatgagccaaaagtatgcggaggataagcggctattatttgtactcggagatatacgcgatcacagaagggtgaatcaggtgatgaaaggcgtcgatatcgtctttcacgcggctgcgctgaaacaggttccgacatgtgaggaccatccatttgaagcgatccagaccaatctcatcggcggacaaaatgtggtggaagctgccctttcacaccgagtgcagcatgtcattaatatcagtacagataaagctgtatctcctgtgaacacaatgggtgccaccaagctgttatctgaaaagctgtttcatcaagcaaaccgccacgtccaaaacaaaggaaccttgttttgttcggtacgctttggaaatgttctcggttccagaggttcggtcatcccgatattatttgaacagatgatggagggtgaacctctgaccatcacagacaaaaacatgaccagatttttcatgtcaatagacgatgcagctacattgacattgcaatcagctgctattacaaaaggcggagaaacctttattttcaaaatggaatcactgaaacttgaagaactgattcatgggtttgaagaatatgcatcgcagcacgggctctcgcggccggctgcagtagaagtgggcaagcgtccaggtgaaaagcttcacgaagaattaacatctccacatgaaattgaatcactgtatgaatggggcaacctttatgcgatccttccagagccggaaaaacatcctgactttcgcaaagtcaatctgcctgggtatcaatcagatcaagccccgctcattacgaaagaaaggattgctcagattattgaagaattgcatcaagagaaaaaggcataaaaacaagcctgtctatccattaggcaggcctgtttttaacactttatttattaaagagatgcagatagctttcgtatccttcttctttcagcttatgcttcggaacaaaccgcagcgctgctgaatttatgcagtaacgaagtccgtttggccccggtccgtcattaaatacgtggccaagatgagaatcagcagttcggcttcttacttctgtgcgaatcatgccgtggctcgtgtccagtttttcttccacttcttcttcttcaatcggctttgtaaagcttggccagccgcagtgggaatcaaatttatccttggatgtaaacaatggcttgcctgacacaatgtctacatacaacccttcttccttatgatcccaatattcattttgaaatggcggctccgtgccgttattttgcgttacttcatattgcatgcgatttaatgacttcaatttttcttctttattgtacgccatttatttagccccccaatgctcgctgataaatcccgctcgtccggaacctgtccggtagcgctgataatgtgctggattctttttataaaaatgctgatggtagccttccgcttcatagaaaggttcagcttttaaaatgtccgttacaatcggatctttaaagatgccgctttccgccagacgttgcttggaagcttccgcaagctccttttgtttttcattatgataaaaaatggctgcgcgataggaactgccgcgatcagcaaactgcccccggcatctgtcggatcgatttgctgccaaaataattcaagcagtttttcataagggaatacatcaggattaaacgtgatttgaacggcttcacgatgtcccgtcgtttcactgcacacctcttcatacgtagggttttcagtatggccgcctgtatacccggacaccactttttcaattcccggctgttcgtcaaaaggtttaaccatacaccaaaaacagcctcctgcaaatgtggcgatttcttttttttcagacatactggtgcctcctttgttaatacgtggtattattatattatagcatgtaaaaatagaatgaaaatgattctgcttttcaataaaatctataggttttaagcaatatgcttatgtaatggaggttcacaaatttgaaagtaagaacacagatgatgtacgatatggaaactttactccgtaaagtctttaaacaaatacgcaatgaaatcaatgaaattttagataaagagctgtcgcggaatgaattcaccattcttcggatcctcagtgaacaagggcctaaaaaagtcactgaatttgcgcctattttagaggtatcggcaagccacattacggctgtgaccgatgcgctggtagaaaaggaatggattacgagaatcagatcgaaggaagacagacgcatcatccgcattcatatcactgaagcgggcgaaaaagtccttcagcactttaacgagaaaaaaacggaatatttctttaaacgctttgactgctacactgatgctgaacttgccacgttaatcgagctcttcagcaaacttgataaaaaacggtgaaaaaaagcacataccgatatataggtatgtgcttttcgcagtgcttcacttatttttcagtaaacagcttcattgctttccagcggccatatctataatacaaaaatgccgcgcagctgctaaataaaaaactcattccgattccaagcccgattcctttttgtccaagccaagctgaaaatagagctgtgaaaggatatctcaacacccaaaacgagattaaatttaataccagaacctgcagcatcgctcccgcggccctgacgattccgttcagcacaaaattaatcccaataaaagggtagaaaaacgcgatccacttcaaatattgttcaccaaatgcgaccgcatcgggctcactgataaataaccttatgagatatttaccaaatacccaaatcataaccgcaatcaccagcatgcaggaaataacagctatcacacccagccttgcaattgttcccactcttttttcgtttccgattccaatattttgccctgccatactgttgacggccgtaccggcagccattgctggaagcgtgatgatgctatcaagccgctgcaccgcgccaaagcctgataccacgtgatctccgtatgagttgacaacactcataatcgccatcataccgcctgtaatcaccatcatctgcagacctgccggaatcccgagtttcaaaatcagcgcggactcttcccacttgggcattctcggaatcgagaatggcacaagcttgtgtttgatgacataaaacaacccatacagaaacgcaatgccctgtgacaaaatcgttgaataagccgctcccgctattcccatgcggaacacagaaataaagagcggcgcaagcactgtattcagtacaacagcaaacgcaataaaccggagaggtgtcttgctgtcacccagcgcacgaagcacagtactgataaagttataaccaaacaaaaataaaatgccgataaattgaatctgtaaatacgtctcagcaagcggaatcattgactccggcgtttttagaagacgcagcaaaagctctgagagaaaaaaaccggcaacgccgaatccgatgcttaggcctgttaataaaacaacaaaagcgttaatatacgacgccattccttttacatcatcttttcctttttgctgagataaaatggttaacgtcgcattgttaaggcccaaaataaaagacagcacggtcaaaacaatcgtgcttgataccgcggctgctccaagggcctttgcccccagtaaattgccgatccacaagctgtctataaattgaaaggaaacctgtaatgcgtttccgagcataataggcattgaaaacagtacaagctgtttcagcacgttcccctgtgtaaaatcgtatgctttcatcttttctccttgtgttctcaaattttcttcggaccgcacgaaaaaagagacgttgtttcatgtctcttttttcatgacttatcggttttttttcggtctcgcataccgaatgtaaacaccatcacacttaggaacaaggcacaataggaaacattcaaatacatttgatccatgtcttcagcagtcagatgatgataagcaagccagccgaagtacagggaaaatgtaaaagataataaactgaaatactggtaaatccgtttcattttcagtcacctctattgtttgggatggtaataggaaaactcaatttcatctttttctaaatttatcttatccgctttgacatacattccattcgttaaaggcatttctgacaaacgcacttcaatgcttttatctccggggtgaacatggacaaatgacggcaattcataaaagctgtccatataatttaacacaaagctaattggtatactcaatttccctaacgaaaatttcgtgacattcagctctacatcaccgttttttttcacggtcggctcaaaagcgataaacgcatcaatagacgtggaaaatgccttgattttccctgcgacatgaacatcatcatcaatctctactttataatcaagcttgtttgatgctttgtcgtttaaatatgagttaacaaacgcagctaatgattcttttgtgcttgtcacttgaaatccatactcgctctcagatgaatccttcacctgagcctgttcccccgggagcaaaacaagtgccacaaacccggcggcgaggataaaattgattgcaagcaatataaaaaacagtcgcttccacttattcatgctgtcaccctactctttcggtaatccttcttttttaatggcttgatagacgcgctttgcgataagagaataacccgtaccattaggatgaaaatcatcttcctcagaaattcggctgctgtcacttttttgattgaacaaatcttcgatatgaacgatttttgcatgtttatcttttttcagctctttttcagcaatatggttccaatccgtgacgacaccatttatttcatttagttctgataatgtaaacgtaaacggattgtacatgctaacataaatcagctcagcgtgatcattcagctcgcgaatttcagaaatgattttttcaaagcgcttttcgtacggtttttccgcttcctgaaacggttcaacggttaattgcagaaagttttggcgaaggattttcatcaaatcattaccgccaattgtaaaaaagacataatctgcgtcctttatgcctttttgaacctttttatcttttagtttttctaataaatcatccgaacggttcccttttacggcataatttttcacgtcgaccgttttgacttgtttatctgaccggatagaatccgccaccttgccgacatatccctttccgtcgggatctccgactccttctgtcagcgaatctccgacagccgctatgacaatgtgttcttttgttttcgtttcatgggctttttgttttccctcagatgatgtacgtatgctcgtacacgcagtaagaagcaaaatcaaactggccatgattgaaaaaatgcgcagcttcaatcttgttgctccttcccattctactagtggaaagtgtatcatgttttagaagatttgcaaatgcctagtctcttagcttacttgagtgtactggctgacttcacatcggaaatgatatcatcgtacggtgtattctccactccattgtaatctttcagcaccttaccgtccggacctaccaaataaaaagaagattgatgaatcacttggtcctctccctccggcttctttacgatcgctttaaagctcttaagtgcgaactcctcaatctcactctggctgtatcccgtgagaaaatcccagttatcaaaagataatggataatttgcggcaaatttcttcagctgtttcggcttatcgttttctgggtcaacactaaatgatatgatgcggacgtctatattttcagctttcagttttttttgcagatcggtcatatgagcggtcatcggcggacatacagtttcacaattggtaaaaataaaatccgccagccatacttctccttttaaactctctaaagaaacgttcttgccgtcttggttttgaaatgtaaaaggctccacctcgtaattgagcggatttttaatctgctgtcctccgcatgcacacaaaaacagaaaaaacagcccagccgttaaccccttgataaccttcatgacatccaccctttccagccagcataaaaacgctttctaaaactgtccttactgtccaatgtttgtattcgatactgagcaaaaaaaatcctgcatgcctccccattaacgattacaaaggaggacatacaggtaaaaaacggcatgttacgcgttgtgctttaacatctcttgatgaaatacagcctgataatctgcccacttcatccggcgcttcatataatgtcggaaagaatacacttttgccctgctgtttgatgaaaacacttcttttaagtagaattgcaaatggtgatgtaacataaagaaatagtgctcatcttcctttaatacaggtatttctgtcactttcacctgaatcccgtcaccgcgtttgaactctaggcttttgagtaacaagctatcaatcctctttttttttttcttctattatatatgatgccagccgggctgtctgtcattttgcgcggttgtgtaaaaaaattagatcagcaaatggaacaagtcctcatccttgttcacctctacataatgaaacggttttttgttcatccgttcaatcagcggcccataatcggctttgttctgcagctcgatgccgacaagagcaggtccgttgcttttattatttttcttcgtatattcaaatcttgtaatgtcatcattcggcccgaggacttcgtcaagaaattcgcggagcgcccccgctctttgcggaaagttgatgataaaataatgctgaagaccttcaaaaatcaaggaacgctccttcatttcctgcattcttccgatatcgttattcccccgctgaccacacacaccacattttttcctttgatttcatccttgtacaaatcaagcgctgcgacagaaagagctccggccggttcagcaacaatcgcacattcgttatataattcaagaatggatgtacatacttttccttcaggcacaaggagaatgtcatcaacgacagtttccagcgtctggaaggtttcctcgccaatttttttaacagccgccccatctacaaacttgtcaattttatcaagtgtgacgacatgcccagctttgtttgattcaaagtaggatgccgctcccgccggctcaacagcaattacctttgtatcaggagacacgtttttcaaatatgtacctgccccagagagaaggccgccgcctccgacacttgcaaaaagaaaatgcggttctgcatcaatgtcgtttaaaatctcgactgcgagcgtcccctgtccggccatcacatccggatcatcgaacggatggataaacgtccgagattcagcctcacagcactcaacggcgcttttatacgcgtcgtcaaacgtatcacctgtcaaaataatatcgataaatccttttccgaatagttcaacttgagatactttttgtctcggtgtagtagacggcataaaaattttcccgtgaatgccaagatgtttacacgaaaatgccacaccttgagcgtggtttccggcacttgcacacacaactccgttctctgtctgctcgctggaaagctgtttcattttatgataagcccctctgagcttaaaagatctgacaacttgcaagtcttcacgttttaaatagatattgcattcatatctctcagaaagtctgtcattcctctgcaaaggtgtgtgaatgacaacgtcctttacgttttggtgagccttcaaaatgtctttcacttggatgagagagttttctttcaacaacggtttcatgtacagattcctttcttgttttaaatccctatttaatatgccattataacatgaatattcaaaaaataagacaattatttttatttaataattaaaaaaatacagactatgtccaccacatcttgtggtaacttctgttcaaccattatcctgcagagccaagaaaaaagatgatcgtaaaataaagggtgttttcaaccaaaaggcatgatataatgaaaccaattagaaccaaaaggagccaattgatgaatagtgcaccaaaactcaatacatttcaacatctaatcggagaacatcaaactttcctggaagcgaagcgaatcgccaagcagttctcgttatcggagcttcctgtcttaataacaggaaaaatcggaacaggcaaaaatcacttcgcacatgccatacacttggaatcttcgagaagcaatgaaccgtttataagcgtcaattgcagcacccattcggaagaaacccttattcatgagctttttggccctaacggaaacacaggtgtttttcaaaaagcagtacgaggaaccctttttcttgatgatgtatggcgcatgcctgcttctgtacaagctcagctgttaaaagcgcttgattcagacacggagaaaccgcgaatgatctgtgcttctgcagaccgatccgtggaacataccttcaggcaagacttattctacagactgaacattttaacgctcacactgcccgaattatcggaacgaaaaagcgatattccgcttttgacacagcattttctctcaaattccggtcagcaattgttaatcgatccctccgtttttcccgtgcttgagaagcatgcatttgaaggcaatgtcagggaattaaaaaacgctgcagattatatggcggcagtatcaagcggaggaacgattcagccatatgacctgccgccatatattagaggcgcgatagacggaaaaacgtcgaagaaaaaagcgaagctgctgactttaatggaaaaagctgagtttttgtttattttggaaacaataaaagtattgaacgaaaaaggagaacctgccagcagacggatcatttctgaacacagcaaaaatacccaaacctcgttaactcctcagcaggtcagaagccgtctcgactatttggagaaaaaagattatgtcaccaaaagccgcggacgcgcaggcacaaaaattacctttgagggcttgagctttatagagacgttaaaaaatcaaatgatctagcgatcgaaaggagaatgtacttgtttacaatcaaagaagagatcgccaatgcgattacacacggcatcggtgtcctcttatccatcccagcattagtgtttctaatcatatttgcggctaattacgggtctgcatgggacattgtcagctttacaatattcggtgtctctatgctgctgttatatttgagctccaccctgcttcacagcatcacacataaaaaaacgaaggacattttggagattattgatcatagcgcgatttatgtactcatcgccggaacctacacgccttttttgcttgggccgctgaaaggcacactcggctttaccctgttggttatcgtatggtcacttgccctaggcggaatcgtttttaaaattttctttgtgaaacggtttatcctattgtcaaccttcgtgtatttagtcatggggtggctgatgattattgcagttaaacctttatatgcttcactgagcggagcgggattcagcctcctttttctcggcggcattttatactctgtcggaaccatcttttacatttggaaaaagatccccttccatcacgccatttggcacagctttgtattgggcgggagcgctgccatgtttttctgcgtgctcttctattgtgtaaaggtgccgttcctttcgtagcagtaacagaaaagcgcagtcttcacgactgcgcttttttatgcacgtaattgtttttcattggcaggtatataagcttttgaaaaggacaattcaatgtctgccggttttaagcgtttaaaaaacgagcccttttgcatgttatctgttcctttcgtttccaccatcaccaacggaagatgatagcgggccgcaagttctataggatcaatagaaccatctagtgaaagaatcaggctttgtcccttttccagctgttttgtcacatcttcatataccttttctgaatcaccgtctgaaatcacatccatccgatccagccattgcccgataaaaggcaagcggaacacttttgggttggcgataaagccggccggttcctcaatatatccagcaattaaggccagttcagccaaacgcaaacggggatgcacatacaaaacaggaccgtgtggtattggctctggctgatggattgtcacaactgaaccggagatgccgatacagccttccaaaaacgcctttggctgttcgtacacaagagtcatctgttttttgtatgacagacggggatcgagcattgtttgattaaataattgtttcatattttttaacagcatatacacaatataaaccactagaaggctgtagcgaaccaattaaaatcctcccgctttagaagaattctttttttcatacattagaaattcgtaatcatacgggtttttttcgtctttgatcccctgctcagaagaaaccagcttccaattggattcatcaaattcagggaaatgacggtcaccctcaaactcgtgatgaattttcgtcatatacagtctgtccgcataagggaacaggtccgtatagagctgagcccctccgatcacaaagcattcttcagggcctgaacaaatgtccagtacatcctttaatgaactgacaaccgtgcatcccggaaattctgaatccggcgctgaggtaacgacaatatttttccgatttggaagcggacgtccgatcgattcaaatgttttccggcccataatgattgaatggcccgatgttattttcttaaagtatgcaagatcattgggcaaatgccacggcaaatcattgtctttgccgataagcctgttggcatccatcgcaaaaatgaatgaaatcatacgctgaccgccccttttatatgaggatgcggatcataatcctcgatgataaagtcctcaaatgcaaagttgaaaatagaatcaacctttctggcgaaacgaagctgtggaagcggtctaacatctctttccagctgcaaattgacttgttcaatatgattttgataaatatgaacatcaccaaacgtatggatgaactcgcccggttcaagcccagtcacatgagcaatcatcatggttagcagggcataagatgcaatattaaacggcacacctaagaaaacatcggcagagcgctgatacagctgacaggacagcttgccgtcagacacatagaattggaacaggcaatggcacggcggcaacgccattttatcaatttcaccaacattccaggcgctgacgattaagcgtctggagttcggatttgtcttaatatcttcaataagacgggaaatttgatcaatggtttctccatcagctccccgccaagaacgccattgggagccatatacaggtccaagttcaccgttttcatcagcccactcattccagattcgcactccgttttcctgcaaatagcgtacattcgtatctccttttaagaaccacagcagttcatgcgcaattgatttaaagtggagttttttagtggtgagcatcggaaagccttcccgtaaattaaatctcatttgatatccgaaagtgctgattgttccggtccctgtccggtctccctttttctcaccatgctctaaaacatgtctgcataaatccttatactgtttcatttttttcatcctttaaaagtagtcttctagtagtgtaacacaataaaaaatcatttctgaacccagaaatgatttttttatagtcagctgacgacaggcttttcatcctgttctttttcttcatcttgcagatcctgatgcgtatgtgcaattctgctcgccgctgctgcagcaagagctgccacaatatcatccaaaaaggtgtgaataccgtctggactttcatcaagttccttaataattccaatcttctctttatccaaataaccgaaattggtcaaaccgatcgacccgtacacattaacgattgaaagcgggataatttcatctatgccgtaaagcggttcatccgtttcaacaaggtgctgcagcggttcggggagaagcttctgttctgcaagctgatcgagtgcaagtcctgtcaaaacagcatgaataatttcacgtttgttcaggactttttctacattctccatgcaaacactgagcggcagatttggattgtattttccctgaagtttttgaacaatccgcgcaatatcttctatcataacgccccgtttgttcagcatatcctttgttatatcgaccatttcattcattgtgtactttttcatgtctaatggcatctcctttaggcactcatccagttgggaggcgtgttgcggtcccagtaaatgctcccaagctcatgatgtgattgaaatccatcttctgctgtatgataatgaaaattaaaccagtagccgtcatgcggcggatggtctcttcgcacatggaatctgagaagatcttctccagttgtccgattgtaaacgttgaaaattttttccgttttgcccgctgaaggcatgcttgagatcacaacatcttggtacgcctcatcatcttgcaatgtcgctaaatattcactaatcacattttcgatttttggcaggatctctttccgatagtcatcctcaatgaccggagcgattctgctgccgaattttaaaaaggactgatcctcagcgctgtcaaggagctgttccttgtacgattgaaaaagcagttcaggattttgcctgtcatccgactcatcatcgtacaggtcatgctcatcataaaaagcggtgtaatcattctgctcaagactgctcggctgtccggaaggcttgtccgccataagggcagccggaggagatacgagcccgaacgttacaatggtaaataaaaccacaagggtctttctcatccacaatttcatgactgcttattcctctctattttattgtcatgtttctcttattttagcacatccaaaacatgcaagtcatgtactatatgaaactgatatgcaaattaggagattcgttgctatgcactttgtgtaaaaacgcttacaatattccatgaaaggaggctttccgcatgattgacgctctgtttgccacagtttcactcttaacattattatactttgtcgtcatggaggtcaccgattaacagaaagcccgtgatatgaatcacgggcttgtttgaatgacgccataatggaacagtgctgtttttcttttcatgacgttaaaaccaaactgttcaaaccgcgggcttttccagtggtcttttagcacaacgctttttctggcgactcgtaccgcttcattgatacatccttcgtgtaaaactgaatcctctgccaaatcacgtaaaggcgcgatgccgtcagaggtctctacaggttcatgaaacattggatcgaaataaaccacatcaacagagttgtcaggaagctgtttgatgaattctaagcaatcaccattcttcacctggattcttctcatcgcagcttgaagctcttctatacccgtttcccatgaatgcagccccatcctcactaaaacagacacaagatggtttttttcaatcccaacaacagaacccgtttcgcctactgccatacttgcgataatggcatctgaccccagcccgagtgtgcaatctaaaaacgtatccccttcagataagccggcagcccgaagcataggctcttgctctccctgtaagaagcgtttggctctaaacatcgctgtattcggatgaaaaaagaatttggcaccttgtttcgtatacagctcaaaccgctctttgccgaccacaagcaaatcacgttcagctgacctcagcaggtgttcaaccgtttgtttattccggccgcagtatggcatatttagctctttagaaagctgctttgcggtttttatggtgtgttcagacggtctatagcttgttgttatcatcttctgtactcccaaaaagaaaatgcccggaaaacgggcatttagcagtgcgcatcgaaggcagcagtcagatttttcatgatttcttccatatcgtgtccttcaatttcatgacgcggaataaaatgtacgacttctttgcctttcaaaagagccattgatggtgaagaaggctcctggccagtaaaatactcacgcattttcgcagtagcttctttatcttggcccgcaaaaacagtcaccgtattgtcaggtgttttgtcattctggaggactgcctgtgtagccgcaggacgcgcaaggcctgccgcgcagccgcatacagagttaacgactacaagagttgtgccctctgccttttccataaagttttctacttcttctgctgttgttagctcttcaaaacctgctccagtcagctcgcggcgcatcggtacgacaagctggcgcatgtattcttcataagccattgacataaaaaaagccccctctagtatccttcatctgaagtaaaggatactatagagagggccggatttcaaatgttcacgccttaaaatatagaagtaagtgtccccagctgtctagattttcataataccgccggtgttggcacttgtcacaagtttagaataacgtgccaggtagccggttttcactttcggttcaaaacctttccagttcgcttttcgtttttcccactcttcttctggcacttgtacatccaagatacgtttttcaatatcaacgataatatggtctccgttttcaacaaaggcaagtggcccgccctcagcggcctcaggtgatacgtggccgattgagaggccacgggaggctccggaaaaacgtccgtccgtaatcaatgccacttttggtccgagtcccattccaacgatttgggatgttggcgccagcatttccggcatgccaggtccgccttttggcccttcgtatctgatgatgacaacgtcgccttcttttacttttcggttgataatgccgtcaagcgcctcgtcctgagaatcgaatacgacagccggcccttcgtgtcttgtaatcccattctgtacgccgcctgttttaatgatagcgccgtccggagctagattaccgaataaaacagcaaggcctcccttttcagtgaatggttgatccagcgggtgaatgacgtcataatcctttacttcatgtccggcaatggtttctccaagagtttttcctgtaacagtcagcgcgtctaaatgaagcgctccttctttcttggaaagctcattcagagccgctgacacgccgcccgcttcatgaagatcttcaataaacacatccgatgcaggcgccagcttggccaagtgcggcacgcgctcagcgacttcgttaatgcgttctaaagagtattcaacgccggcttcgtttgcaagggcaagggtatgaagaacggtatttgtagaacctccgagcgccatatcgagtgcaaacgcgttatcaatcgcttttactgtaacgatatcacgcggtttgatatctttgcgaatcgtttccattaattgcgcagccgattttctcacaaactctttgcgttccggagatgtcgccagaatggttccattacccggcaaagcaagaccaagtgcttctgacagacagttcattgagttcgccgtaaacatgcctgagcaagatccgcacgttgggcatccgaactgctctagttcttgaagctcgttttcgttgattttccctgcttgataggcgcctaccccttcgaatactgaggaaagggagatttttcgcccgtcacttgttcttcctgccgccatcggtccgccgctgacaaaaatcgtcggaatgttgatgcgcattgccgccataagcattcccggtgtgattttgtcgcagttcggaatacagaccattccgtcaaaccagtgtgcggatacaaccgtttccacagagtctgcgataatttcacggcttggcagcgaatatctcataccgatatgccccattgcgatgccatcatctaccccaatggtattaaattcaaacggcacgccccctgcttctctgattgcttcttttacgattttcccaaactcctgcaagtgaacatgaccgggaacgatatcaatgtatgaattacacaccgcaataaacggcttgccgaaatcctcttcttttactcctgctgcacgaagcaaactgcggtgcggagctctatcgattccttgtgtgatcatattactgcgtaattctgccatggtgatcctcctaaattctttcaattgtttgattggattttattttgacaattttcagtttatttatgagctgtttttgcaaataagataaattcaggccgccctcaccttgttttgttctttcgtgtttttatatttatatagctttctttcgatttgaaccctccaactattaatattgttacttactataaatagttttcggatatttttcaacaatattcgaaataatttttataaaaagtgaattcacataaaaaaggtgcatgatctgcaccttttttatttctattcgcctttttttctgctttccgtcatttgtttccaaacagaaccttttgcttcttctccatgctcaatacgttcaagcgccattttgacttgaaggctgacctcaaattcgggatcatcttcggcagcgcgcaaagcttcaattgcactttcatcgccgacttcgtacaggaacatggccgcacgccagcgaacaagcttgctggagtcgcttaacgacttgatcatagcaggaatggcttgaggatcgccgatatcagacaggcagtctccggccgttcttctgactgatacagctttgtcctcaagtgctttatacaatagaggaagaacatcaggtgtttcaatcattcctaagtacacaacagcctgtcttctgatggacacctttggatcatccaatgccttctgtaaaaccgggatatcctcttctttcggatccatctgttccaagtgtgcataacgctttttccagtcctcatcatccagcatgtcaagcgttactttatacgctttgcgctgtacagcttgttttgcttcgccctttccttgagcggctgcttcagtcagtcgtttcagccgttcatcactgtatgccgcctgaagctcttctgtcacgtcatggccgatttcatcaaagtcaccgaatctgacaccctgttctttccaagcccgctcaaacacaacattggaagcttcagatctaagttttaagatcgcctgctgaaagcgttcaggtaagccgaagcgttcttcccgctctccatcggttaatttaacttgcataggaatgccgctgaacatctgcacaaaaacttttacctctccaaaagattcttgatcagaacgattttcttctgcgctttcagcactttccatcccaaatgcagtgcggacttgcggtaaaatgtctttccagtcgtatcttgcattccgttcaacagcaagaaaatctgcgacgtgatagacccctttaactccatctattttaaggatttccgctataacaggcggtgcgccttctgcttgctcaagtttatagttattgcttttgcccgccggaagctcttccgttaagatgactttcattgtattcgggcttggtgtaggttcaattgattttatcttcatgatcgtcctcctatagcatatctgtgacttattctatcatagtcgctccaagccttctattacgacgttttggcatcaatcccgggtatgtctttttctaattggcggacaaattgaagcataaaattgtgtctttcttctgccagttcccgtgcagtgtctgtattcatcatatctttcagccgcagcagcttatgaaaaaaatgagcgtaggcgctttgatcatctccataaaggccatgcccgtttgcgcccgcaaacatgagaactcgcgcaatgccgacagcaccaatcgcatcaagtctgtcagcatcctgtacggcttttccctcaattgagagcggctccttcgccagcttttccctgtctcgaaaggacatccttgttataatatgaatcaccctgtcagcattctcttttcctactccgaaaaaaacgagctgatcatatacttcgctcacagaaagcctgaccgtgtcaggcagcttcacatcaattaaatcatgaaccaaagccgccgtttcaacaatgaacaaatccgctttttccttttctccaatatacgctgcaatatctgctactcttgatacatgatgccagtcatgtccagagctttcgtcagtcaggatagattgaacccatgtcctgatttgctctgcctgcttcaattccttcacaaaaacaccctctttttattgctctaatagcttcacgatatcgtcttccagctctttcggatttgtatttggtgaataacggccaacgatttctccatttctatccactataaatttcgtgaaattccacttgatcgccttagttcccagcatccctttcgcatgttctgtcaaatatacaaacagcgggtgggcatttttcccgtttacatccacttttgaaaacataggaaatgtaacaccgtaatttgtttcacaaaattcctgtatgtcagcctcttcaccaggctcttggttcatgaattgattgcaggggaaccctaagatctccagcccctcctgctgatatgtatcatataattcctgcagctgctttaattggggagtaaaaccgcacttacttgctgtattcacgatcatcagtacctttcccgcgaaaggctgaagtgtcatgtctttccctgtgattgtacgtaccttcatatgataaatagacatgtaagcccctcctatgtccctggtgctgattattttaccttttttaaatcgcaattcaaaatgtaaacatcaattaagaactcataagaaacttaacaatatgaaacgtccgttcattatcaattcatatggctcattttttatcttatcattctataaaacattacaatcccctctgacatcatggaaaatcattttactgtgaaaccaaaaggcgtgtcagtgcgttttatttaaagagttttctgttgtttccccctcaacacgcatagatagattgaaaattggcgtgaaaattcctataatgaagaaaattaacggggaaataatggaggtggcacgttgcctattaatataccaacacacctgccggcaaaacaggtgcttgaaagtgaacagatatttgtaatggatgaaagcagagcatttcatcaggatatccggccgcaaaaaattattatattaaatttgatgccgaaaaaaatccaaacagagactcagcttctcagattgcttggaaattcgcctttacaggttcatttcacatttttaatcccaagcacacacacgccgaaaaatactgcgagagaacaccttgacgaattttacacgactttttccaatatccgtcacaagaggtttgacggcatgattatcaccggtgcgccgatcgagcatttggcgtttgaagaggtttcatattgggaagagctcaaggaaatcatggagtggagcaaaacaaatgtcacttcaaccttgcatatttgctggggcgctcaagcaggtttgtattaccattacggtgtggaaaaaattcaaatgccgaaaaaaatcttcggtgtgttcgaacataccgttctttcaaaacacgaaagattggtaagaggttttgacgagctatactacgtgccgcattcccggcatacagatataaatatggaacagcttcaagcagtgcccgagttaaacattcttaccgcatcaaaggaagccggggtttgcttaattgtgtctaaagacgaaaaacaagtctttttgacagggcaccctgaatatgatacaaatacgcttcttcaagagtatgaaagagatttggaacgaaacctttctactgtcgaggcgcctaaacattattttgcaaaaggcagcaacgagccagtgaatcgctggaaagcgcatgccacattattgtttatgaattggctgaattattacgtttaccaggaaactccttatgaatgggactaatttttctttttttagtgatacgctgagcaaaaaatatgataaaatacatctgattcagtctgcgtataacaaaaatttaaaatactggaatccaaatcatttaaaattagcttaactttttcactgcattaataattcgattatgtatttgtgttatgtttatgtatagacaataactccttacgatgcatgaagcttgcttgttgttgattacattgaggtgaatttacttgaataccaataaaagagtattaattttgactgcaaattacggaaatggacatgtgcaggtagccaaaacactatatgaacaatgtgtacggctcggctttcagcatgtaacagtttctaatttgtaccaagagtcaaatccgattgtttcagaggtaactcaatacctttatttaaaaagcttctcaatcgggaaacagttttatcgtttgttttattacggagttgacaaaatctataataaacgtaaattcaatatttactttaaaatgggtaataaaagattgggcgaacttgtcgatgaacatcagcccgatattattattaatacatttccgatgatcgtcgtgcctgaatacagacgccgaactggaagagtcattcctaccttcaacgttatgactgatttttgtcttcataaaatttgggttcacgaaaacgtggataaatattatgtggcgacagattacgtgaaggaaaaactgctggagatcggcactcatccaagcaacgtaaaaatcacgggaattccaatcaggccgcaatttgaagaatccatgccggttggcccgatatataaaaagtacaatctttcaccaaacaaaaaagtgcttctgatcatggcaggtgctcacggtgtattaaagaacgtaaaagagctgtgcgaaaaccttgtcaaagatgaccaagtgcaagtggttgtcgtgtgcgggaaaaatacggctttaaaagaatctttgagtgcgcttgaggcggaaaatggcgacaaattaaaagttctgggctatgtggagcgcattgatgagctatttcggatcacagattgcatgattaccaagcccggcggcattactttgacagaagccacagccattggagtgcctgtcattctgtacaaacccgtgcctggccaggaaaaagaaaatgcaaacttctttgaagaccgcggagctgccatcgttgtgaaccgtcatgaagagattctcgagtcagtcacttcccttcttgcagatgaagataccttgcatcgcatgaagaaaaacattaaggaccttcatttagcaaactcctctgaagtgattttagaggatatcctgaaggaatcagaaatgatgactaccaaacaaaaagccaaagtgctatcgtaatggcgtacttgagagcatacgaaaatcgtgtgctctttttatttatattcagccattaataaaagcggttacatttttttatgaaacttgcccttcttttgaaaaataagccgtttcgaaacttgacgggtgctcccagatggtgtatagttgaaccatcatttaacaatgaatcaaagttagatgatgacaaaattttttttagcacatgggtgctacagtactaggaggaattaagcaatatgcaaaacggtaaagtaaaatggttcaacaacgaaaaaggattcggcttcattgaagttgaaggcggagacgatgtatttgttcacttcacagctatcgaaggagatggatacaaatcattagaagaaggacaagaagtttcttttgaaattgtcgaaggtaatcgtggacctcaagcttctaatgttgtaaaactctaaactcaatacatgatgatgagatgacaaatagaggagaggcattcgcctctcctatttgattttcatctggatttcaatcgccaaaatgttttgtttacacctctgttcaatctcttcaacatacttttccattgatggttttccttttttcgcgatatccgccagttcttctaaatcactgtatatttctataaatgttttgtgaaggatcaacttcaagtctttatcatccatagctgcgttccccttctctatcaagatacctcaaatagtaaaacggtcctatttattctggttcaatagttatatcggcttatttttattttcttttctattttggtacataaatttcaaaaaaactctgcaaaataatggcggaggtgttttttgtgacttcagaatttcataatgaggatcagactggctttacggataagcggcagctggaactagcggtggaaacagcgcagaaaacaacaggagccgcgacgagaggccaaagcaaaacattagtcgactctgcataccaagccattgaggatgctagagaactgtcacaatctgaagagctggcagctctcgatgatcctgaatttgtaaagcagcaacagcagctgctagatgacagcgagcatcagctggatgaattcaaagaataaaaaccgcagcttctgcggtttttatttttagtgattggttaagacatctccgtattgtttcagcttttcaccaaccgtacatttattgatacaaaatgaatgcgcataagttttgccaaattctttgcgaaactgcttcttaataaaacagtccttgcaatattcatcgtgcagttctgtcagttctttaaagatcattttcttatccaatatcgtcatctccgttacggtctaatttcgtgtggctttctacgaattgatgggatagaatttttttagcgaggccgtcagcttcctgattgtcttttcgttgtattgtttcgtaggttggagtaagcttcagcgattcaaggagtgcttctattttgtccagccattcattatgagatggatcataacaaggccagctgccgtcaagctgattcagcacaacaagcgagtcccctttgattgtaattgaatttctgcttgccccaagctctcttacttctcttattgcttcataaagcgctgcgtattcagcttcattattggttttcagccggaagcttttattttttctcaagcgatgccgggttcctcccagtgaataatagatgacgatcccgagaccggccagttcgctctccttatcgaaactgccgtcaaaataaacagtaatgtcatcaggctcttgagcaagctcctctgtcagcttttccaattccttcagcatccagctgccgcctttctcgtcttcgaactctagctctttcatgtatggaaaacgtccaagttctctggcgagcatacgtgcctgctgtgctgtcagccagtcttcgctaaaaaatgagacggatcctgttccttttgcttctattttcaaatgcggtctgagcttcattacaatcaccttaccattcattagttgtcgggcttatgctataatcaaaccaatcttaccccggaaaggaagctttttcatcttgtttaataattcgttttggatcttttttgcgatcattcattttatcattgttcttttattttataaaggatttggcaaaatggggctgtttgtttggatcggttttgcgacagtctgcgccaacctccaagtcgtcaaaacagtggaactgtttggcttaacagcgacactcgggaatgtgatgtatggcacaatcttttttgcgacagatgtgctgaatgaaaaatacggaccagctgaagccagaaaagcggtatggctcggattctcaacgctcctgacgctgacatttgtcatgcagggcgtgctgcttttcgaaccggcttccagcgacatatcacaaacagcgctagaaacgatcttcggattccttccgcgagttgcgttaggaagtctgcttgcctttatcttcagccaaacgctggatgtttatgtatattcggcaattagaaggatatttccttctgatcggcttttatggctcagaaacggcggcagtacagcagtcagccagctgtttgatacattcatattcacttcagtcgcctttctcggcatttatccggcaggcgtgtggcttcatatttttatttctacatatttgattaagtttacggtatctttgatttcattgccttatgcttatgcagccaaaaaaatgatacctaaagatgaaaggagttcataatgcctacagaaatatacgtagacggcgcaagcgctggtaatcccgggccttccggtatcggcatttttatcaaacatgagggaatagcagaatccttctctattccaatcggagtgcatacaaatcaggaagcggaatttcttgcattaattgaagggatgaagctatgtgcaacgcgcgggtatcaatcggtttcctttcgaaccgattcagatattgtggaacgcgccactgagcttgaaatggttaaaaataaaacgtttcaaccgttcgtagaagaaatcacccgattaaaagcggcattccctctttttttcatcaaatggataccgggcaagcaaaaccaaaaagccgatcttctggcaaaagaagcgattcggctgaatgaaaagaattaaatcttgatcattggttcatcctaatggcgaggtgaactaacatgaaaaagaaagataaaggccggctgaccggcggtgttactccgcaaggcgacctggaaggcaatacacataatgaccctaaaacagagcttgaggagagagcaaaaaaaagcaatacaaaacgctagagaggatctaaacgatctctctagcgttcagcttttcaagcatacgctcaattcctttaatttggtggcggcgaagcatgtcagccgcctgctccatttgcaaagtaaataaagcgtctttcagtgtgcaggccagcggcactgagcaatggatttccgcaagcttcctcgacatctccaaatcgcttaaaccttgctgaatttttccctgctgtccttttggaagaagagaaagattttccaataaacggtcaatcgtttcatattcacgaatcagtttgtaggctgttttttctccaatgcctttgactccgggatagttatcactggaatcacccataagcgctttaatatcaatcaaagccttcggcattacgcctgtttcttcataaaaagtctcttttgtatagactttataatttccgattcctttttgaagcaaagcaacgcttactttatccgttaacagctgaagtaaatctctgtcccctgttacgaccgtaatgtccgcttcattcgcaaataaatcggcaagagtaccgatacagtcatccgcttcatagccggcaaagccaatattcatgattccaagctctgcggctgcttcctttgccaaatcaaactgcggaatcagctccacaggcggcgcgctgcggttggccttataatcttggaacaagtcatttcggtacgttttgctccccatgtcccagcagcagacgacgtgtgtcggctggaatgtttccacagctgtaatcaaatgctttaaaaagccgttgacgccgttcgtcggcaccccgctgtcatttatcataaagttgcgatgtacggccgtggcaaaaaaggcccggaataaaagagccatgccgtcaaccagcaatagtttattattattcatcaaataactcccttttctttcattccttctattttatcataaagcagcccaaaaataaaaaacagtatctctttaattagagatactgtttggatatttatcaatcgttgtgtcttttgttgctggcgatcagcttttcagcttcgcgtcctgcgtaagagtcaaaatgggtttgaaatccgtttttctttttggcattgttattcgcctgtgcatttctgtttccgagctttgttctgcccaacatgaatcccccttacgtcggatgcatatagtatatgcttccggcaggaggttcactcgcgacaggatcatccagcttacatgcggcttacgtattctctgaccatttcttttgatacaagccgtcttgtcgggacgatgccttttttagcgagctgattcatttgctcggtaatttcattaattgcatctgtagtataaggctcatcgtttctgcatttagcaacagcttcttcaatcgccaattcacgcatattttcaagacgcataaatgctttgatatgctcgtgctgttttgatgaatgtgctgaaattgctttatgtacctctgacattaatcgttcatctcgcttttttctatttagtctatcatgacttgaaatacaagccaactgaattttacatttttattgtattgtctgaatttttccaggaaatgcacgcctgatacgccatttcaatctctttcgcatgttccccttccgcatatcctcttaaatatgtctctttttgatccgttatttgcgcgattgctttttcacccatatcttcctgtaagcgtctgaggtgagcagtgtaatgagatatcaggctttcttcttcattttttatccatgcctctgtgattttcgtaagtttcatccgtacagcttcgataaaggccgcttttcctttctgctcaaaaaactgcttcggtgatttgatctcttttagttcctgctcaaaagcacgttcttctatttccggttcaacttccttcaactgtatgccgttcgaatgctgatcacccgcataaacggaaaaataaccgtcctcgtttaatgttttttgaaaatgatccagccattcttcattgatatgccgttcgatgaaaccgctcatgcgaacatcaagcgttttgatttcctgaatatattcaaattgatattcatgtatggctgttgtcatcgctttactgacgttctttttccaatccccgttttgcagcccgggatgaaatgccgattttaataaatcatttgcaaaatatgataatcgctgtgcaatgtgatatagctgctctcttgtatctttttttactttttcaatgatggtttttgagttccgccgtttctcgatatcggccgctgcctgctcaaatgacagcataaggcgctgtttctgcgcttccttctcttctcgggactgatgctgggattggtgaagctgaaaaacggtttcgcatagtttgtctgcctccgaactgagctgcgctgctgacgctttttttacgtccacttcgataaaccggtctaagtgttttcttacttttgagaactgattgtaaaatgactccggttttcccaccagttcctccttacttgatacggtaaagagctgcggctcataaaccccttcttttacaagctctgcgctgacataatcggtcactgtttcgagctctgttttatcttttgcaaggtctgcagcattaataataaaaaacattttatccatgctgagcgattctttcacaagtccaagctttcgcaaaaatgaacggtctccttttgaaaaagagtgctgataataagtcatataaaaaaatgcatcagcatctttgatatattggaatgccagttctgtatgccgtttattcatgctgctcgcgccgggtgtatcaacgatcgtaatccctttttcagttagcgggcatgtatagtagaccgttacctctttcacagcacaggccgttgtttcctctgctacatacggctttaattcagagatcggaatcgttaatttcttctgttcctgtatatactgctgatacttctcgtatgcaagcaggaaattgctgatcaatttcacgtgttcttcctgcagcctgttttttttgactgccttttcccacttctctgtgaaggaacggcctgccggttcctttggtattccggtgagctgcaaaatttcagccgttatgtcatcctctgtcttaaacactacatccgctgttttgtttaagttgccattgattggctttgtgatcttgttaattgtcgctgtggttggcgttggtgaggatggcagcactctttcgccgacaagcgcattggcaaatgatgatttccccgagctaaagcctccaaaaagagcgagtgtaaatttccgttcctcaagccttttcaccctttcacgaaacgctgaagtttgctttaacaacatgctgtattcgcctaaaaggtcagacaaagtgtaaaagcgtttgatttggtcttgaagcggcatttcttgttccattttgatttctgatttcggcatcggctgcgccgtcagctggcttcggccttgtttctgctctggagccgccactcttgttttcttcgatttaaaccattctgtgtctatatgcattgggcatgcggactcttcttcccaaatggcccacaggcgatcggttttctctcgggcattattctctaaacacgcctgttcttgaagaaatacaagtttttctgattcttggacgagccggtcgttaattgtttgcacatctttggaaacacgctctttcaccatagcggagagcacctttatgatgtctgcggcttctcttttcgcctctttcctgatgagctctgctaagtcttttgtatattgcaatacatattcagaggaaaaggctgcaccatgcttgaccgcgcgttcaatgatgcttatatcaagcggtgtgcgataggcctgaatcagcttttcactttcagcggtatagacatcaaataccttggcgagtttatgaagcgtgtctatcatatgccaatccgcttcggcctctgttcgttttgccacatcagagaaaaaagcattccgccttttatctctttcctgtgcagttttcgctttagaaaagaaaaagccggttttaaaagaaggctcttgtgattctaaaaatgcagccgccaattcacgcatttcaaaaggcgtcaggtttgcgttttttaaaatacgattgatttcttcctgcatcctcttctctgcctcagtcgtttgtttttcggcctcattcaattgatcacgcagcgattggaccagtccaatttggatattaagctgttcagcgaaactcggagcgcctgtttcgtctttcttcagcatttccgtatgttcctttagcagattacggactttttgttccgttaaagcctgcatattgctttttgattgctgttctattcttcttaactcttctctcagggcccccatctgattgaacgggtgatccggttctgttactgatgtaaaatagagcgcttcccttgaaatcccttcattgcaaagcatctcctctacctgcgcttgatagtctccaaatttcgtctccgtctcatcatggcggtcaatttgattgacgataaaatacacattctgaatgctttcttttattgatctgagaaactttacattttcctcagagtgcacgtgattatagtgaacgacgtaaaacagcgcatccgcttggtgaagaatagaagcagccgatagaaaatgagcatcatctgttgaatctatccctggagtatcaatatacgcaaccccggaatcgatctcagtatacctgtcaaaaatttcgacgctttcaatctgttccccgtctttacaatattgctgcaccttgtctttctggtaagccccttccagctcagcacacgctccgtctgttgtatgaagccgaactcgcttttccccgtttctgatcacaacaaggttagcgcttgtcggaatcgggcttgtcggcaaaatattctccattaacaggcagttcagcagtgacgattttcccgctgaataatgcccggtaaacgcgatataaacctcttcatcagccgcttttttcatgaccgcagccagtttagcagccctttgttcatcttgattctcaataaattgcttataaatttccccagttttatgcaaaagctcttttctgttttgatctgtcataagtctgaacccctttgtgccgtttcaattgtgaacctttttcgaaagatctgaattcattccctttacattttacacaagaataaaccaaatttctttaggagaatagaaaaaagccgccattacggcagcttctataaaagaaaatctgcaacttttacaagttccagattcatcaaacagatttattagagattccttttaatacaaaaccaattaatacactatatgtacaaaccgctccaagcaaaaacagcattgtcatttgcttcaccatcctgattgagaatctttttcaaattcattttaacatggttgagaatgattttcaatcgctattttacgctgtattcctgtaatgctttgtcttctgcgcgaattctgacgcttaacaacacggcattgaaaatggaaaacagacacatggtgacgtatgcttgataaagcagcggaatcagcaaaatttcgagtataacaacggcatagtttggatgtttcatccatttatatggacctttttttacaagctctacgcctggaacaacaaggattttcgtattccaatatgctcctaaggaacaaagcgcccaataccttactatctgtacgcttaaaatcactgcagcgataccgagccaccagttggacggctgtttattcatcagcagcacctcggcaattaaggacaggaaaaaaaggatatgcatcgtaatgatatacggatagtggctctcgccaaattcaattgctccttgcttctttaccttttgttcgttttgcctggccactgccatttctgctgctctttgaacaatgagaatggcgatcaacaaccaaaacatgagtcaagccccttttcccagctgaataacagcaactctgatgagaaacccggccctaatgcgccaatcattcctcgttcagcttcctttttatgtccgttctgcagatggtctttgatcacatacaagattgtggctgaagacatatttccgtgcttttgcaaaatgctttgcgcagatgaaagcttttctgacgatagcccgagacttttgatgtatgcatcgatcactttttttccgcctggatgcgccaaaaaaacactgatatcatggaatgacagcttatgtttgtccaaaaaaatctgtacatttgttttgagccatttttccaccaaggtcggaatgtctcgtgagaaaatgactttgaatccttgatcggtaaagtcccaacccatgacatcttctgattgtttcatcaaaacagattgggcgtccattatcttcggcgcaagttgcagctttgacatcctgcggtccgccttctctccgcataataaagctgcggcaatgccgtcaccaaaaagcgaggtgccgatcagattgctttttgttttatcttccggctggaatgtcaggctgcacagctcggcagaaatgacaagcacaaaagccttaggatacgctttgcagtattcggctgcacgcgcaagtccgctggctcctcctgcacagccaagcccccaaatcggaatccgcttcgtatatggagaaaacggaagttcattcataagccgcgcctcgatactcggtgtggaaaggcctgtactggagacgaaaaaaacagcttccactttctcataaggaatggcttcttgaaaaaattccggatgagagaggcactcacgaacagccgctctgctgtgtttaagtgtttcttctatgtatatttgatttttttcttcaaagctgtgcccctctttataccattcaatcggcttaacaaactgtctcgaatggatttgcccgtttttaaaggaggataacagccggtcaatatccttaaaagaatgctgaaacatatagcgggcgaactcggccgctttctcttggtttacattatacgcaggaagacttgttccaatggataaaataaacgccatgcgatcacctctttgcatacattgtgccgcaacaatcttttttatatgcaaaaaaactccgccgcggcggagttagactgctgttttttgttcagcgaggtcagcttcttgttctgattttttagctttagaaaaaacgttatatacaatatttaagacgactgcagtaaagctgcccgccacaatgccattcgttgtaagcagcgttaaggcactcggaagctgtttgaaaatatccggcacaacggtcacaccgagccccaatcccactgagcaggcaacaatcagcagattttcctgtttcgcaaaatcaatgcggctgagcattttaattccgtaagcaatcaccattccaaacatcgccaccattgcaccgcccaaaacagcggatggaataatggtcgtgaaagcagcgatctttggaaacagcccaaatgccattaggatcacacttgtgaccacaatgacggtattttttttgatccctgtgagctgaacaagcccgacattttgagagaatgccgtgtaaggaaaagcgttaaaaataccgcccagaagcacagccagtccttcagctcgatagcctttagacagatctttctctgtcaaacggcggtttgtcaggtcacctaaagcaaagtaaacaccagttgactccacaaggctgacaattgcaacgatggacatcgtaatgataggcgctgcgtgaaaagacggcgctccgaagtaaaatggctgaatcatttgaacaactgccgcgtccgaaacattatcaaattgaacttttcccataaaatatgcgatgaaggtgccaatcaaaataccgatcaaaatcgagacggacttgataaagccttttgtaaaacggtatagaagcacaatgatactcaacacggtaaaagcaagagcaagattggagagatctccgaaatctgcacttccttctccgccggccatgttattcatggcaaccggcatcagtgtaataccgataatcgtaacaacagagcctgtcacgaccggcggaaaaaacgatacgagctttccaaagaaaaatgaaataagaatgacaagaatgcctgaagcgataatgctgccgtaaacagttgaaaccccatattcagatccaatcgctatcatcggcgatacagctgtaaaggtacagccaagcactaccggaagcccgatcccaaaaaatcggttgctccacacttgcagaagtgtagccacaccgcacataaaaatatcaattgatactaaataagtcagctgctcgacggtcagtcccattgcttttccgacaatcagaggaacaacaatggcgccggcatacatggcaagaacatgctgaatccctaaagacagcgttttgccgaatccatttctcatgaatgaacctcctgtacgaaggacacttttccttcttctaaagactgaattcttgccaaagattccactcgatagcccagtttcacaagttcatctcttcccggctgaaatgacttttcaataacaatgccaattcccgcaatagaagctcccgcttgcttcacaatcgacacaagcccgtgcgctgcctgtccatttgccaaaaaatcatcgataatcagcacatgatcctgatccgacagatgggtcccagacactgcgatttggctttctgtttgcttcgtaaaggaataaacagacgctgtcagcaagttgtcggtgagtgttaacgattgatgctttctcgcgaagacaactggcacacccagcttcaagcccgtcattacagcgggagcgatacctgatgattcgattgtcacaattttggtaataccgtcttttgcaaacctggacgcaaattcgtcaccaattctctgcataagcagcggatcaatttggtgattcaaaaaagaatccactttcaatacctgatcagataatacgatgccttcttcctctattttccgtttcagtgcttccatcctgtctacctccgttatgagaataaaaaaagcattgcccgctcaaataaagagcaagcaatgctgatatcacaaaaaaccgtacacgtgcggttccattgctcacccatagtcggacatttacggtgcccggtagaaacttgcgtgccatatccacgcgattatatgagtgttcctattatattgtaataaattatatcaagattctaatctcttgcataggctgaaaataaaaattcccgaactttaattttgtttttttagatatcattcgtatttcaagggggttcgatataaaagagcctgacgacgcgccgccaggcttttgattatgacagatagagatttgaatatttgtttgataaataatcaattaaatagcgaacattcagctcttctcctgttgcatctttaataatgtctaacggctttttccgttttccgtgaatgtgcaccttttccgtcagccattgctttatcggatggaactctcctctttccaagagagcgtcaaattcagggagatcctcaagcattttttgtttcagctgagccgcatacatgtagccgagcgcataggatgggaagtagccgaaatctccacctgcccaatggacgtcctgtaaaatcccctctgcgtcggtctgcggtgtaatccctaaataatcctggtatttttgattccaaagcgacggcagatcttccacagacacttcattgctgaaaatcgctttttcaatttcataacggatgatgatatgaagaggatacgtcaattcatccgcttcgaccctgataaatgaaggttttgattcattgattgcccggagaaaatcatccagggagatgtccttgaactgttcaggtgatgcttcttgaatcttctgatagtacggtgtccaaaaatgtttgttgcggccgataaaattctcgtaaaataatgattgcgattcatgaattcccattgatgcgccgtctgacaagttcgtgccactgagtgcttcatcaatattttgctcgtatatcgcgtgcccgcactcatgaatggtgccaaagatcgccgtccggaaatctttttcatcatatctcgtcgtgacccgaacgtctcctcggttcagcgtagttgcaaacggatgaacggtttcatcaagtcttccgccatcaaaatcgtagccaagctcctgtaaaaaatacagactgagctctttttgcttttctttcgggaacgcttttgtaataaagcttgtatctggtttatttccggaagctgtcacctgtttaacaagagggataatcgcttccttcagctcagtaaacagctgatcaagcacctttaccgtgacgccgggctcaaacaaatcaagcaatgcatcataaggatgctcttgatatccccaatacgtaataaaacgtttattgaattcaatcagctgttctaaataaggagaaaacaagctgaaatcagattttcctttcgcttcctcccacgctgtttctgcctttgaacacagaatcacgtattctttgtattcagcctcagggattttcttattctcttcatactcttttttcgccagttccactgcttttttcgtatcttccgacaagtcatcaaatcgttcatacaggacatcgataagctccttcattcgatctgatgtttggatattgaatatatctgttgaaagctggccgatactttcggcacgatcctctgagccgtttttcggcgcgcctgttctggagtcccagtgcattaacgcaactgcttcgctgtaatgtgagattctttttaaaagatcaaaaaattctttttcatatgtatgtatctccatatccattccctccctattctagccgttccattacaggctaatggaagggggtatgaaagtcaaattgtttgtataaaaggctgccggtatgttttgcggcagcctttttattcagttgattgtcatttgattttttggcggaggtgttctccgctttttctgcttgatttttttatccacccacactgttgccagcggggttaagagcgaggtaacaataacacttgtcgcgatgattgcagttgccgattcagcaactggcgcaaatgaggcattcgcttccgctaatgcgtatggcacagctacagcagcccccgccgtagaagaagcggccacacccgcgacaccgtctccccgcgcgacaaaacgatcaagtaaaaacaaggaactgcccgataaaatgacgacagaaactccgataaaaatgccgagcagccctgattggatcagcattccaaaattcaaggtattgccgagcgaaaaggcgaaaaatggaatgatcgccggcacaaccttgctgaataagtctctgagatcgtgatccagatttccaagtatacatccaagtaaaaacgggatgactgtcgctgccagcgtttcccatgggaatgcggcaagtcccgtcacaccaaacgtcaccatggtcataaaaggaccagattctgtactgataaaggcgaaagcgcccgcatcctcttttcttcccatgtgattcatgagcgccaaatacagtccgccgttcgtttcattcattaccgcgacaattgctaaaacagaaaggcctgcaaaaaagccggattgtatgccatcgtctggtataaattgcgctgcgatcacgccgagtagcgccgcaaatccgatctttcccaataataacgtgattccttttcttgcgatatagcctgaagaacgaaaatcaatcgttgctcctacgcaaaagataaaaacacccagtatcggcagcgttccggtaatcaaagcacccgtaaaccctccaaagaactccgctgttccaggcgcaaacgtgttgagcgccgctccaagaaatagcggaataatcatcattccgccaggtacccgttcaattgtcgccttgattttcatattgtggattctcccatcctccggttatgaaaaaacaattccgcttacacttggaaaacagcctgcaaatcctcttttgaacagctgcccagctggctgccgactccaacggcgccagctccggctctaagccaatccggcacttcagacggatgtatcccgcctgtcggaataaaggtcacctgcgggaaaggacccgctaaatttttcataaacgggatgccaaacacaccgcttgggaacagctttaatgtcgtaaaaccgaatgtcagcgcttccataatttcgctcggagtcaagacgccggggatataatgtgtctttacaaaagatagatgttcagcaagatcagctgaaaaacccggactgacaataaactgcgcgccagcctcagcagcttccccagcttgctgcgcggtgatgacagtgcccgcgccaattaaaatatcttccctattacggaaggattcgataatatctgatgccccgggggtcgtatacgtcacttcaactgcacgaatccctttatctaacaaactctcaatctgctgacaggcctcctgcgtatcctttgaacgaatgactgcaatcagctttgcttctttcagacggttttcaacgactttggactccatattaataatcccctttcttttggtgaaccgttctttgagcagataaaaaagaagctaatttctccctggtcggcaaaccgtccatatcccccggtgcctgcacttgcaaagcgccaatcgcatttcccctttgcaccgcatccttgtacgacaaaccgtctaggataccgctgattacaccgactgcaaatccgtctccggcgccgaccgtatcaaccacccggtcgacccggcagccttctagaaatccttcacttgtccccgttttaaagtaagcgccttcttttccgagtttaatagcgacaaagctggcaccttttttcaaataatagtcggcaatgccttcaggtgttttttctccggtcaatagctctccctctgcgatacccggaaaaaccagtctgcaagcccagctagatcgttgattgtgtgtaccattgttgcttgatcaggccaaagcgaaggccttacattagggtcgaatgaaatggttttccctgcgtttctcatgtcgttcatgacatggtacgtgaagtctttcatctcggctgataaggcaggcggaatacctgtcacatgcaaatggcctgcgcattgaaaataatctctcggatattcagcagaagttaatgtgcttgcagctgagtttttcctatagtaggtaacttgcgggtcgccttctttcacttttgacttaagcagcagcccggtgggattttcgtcctgcgagcggatcacgcgggacacatccactccctcttttttaagctcttgtaaaataaacgttccgagctgatcattgccgaccttgctcatccatcccattcggaatccgagtctggcaaggccgcaggcgacattgctttctgctccggcaagccctttagaaaaagtggatacttcatgaagacctccatactcatttgcgtaaaacatggccattgattccccgaatgtcaccgcatcaagcttcatctcttcccaacctcctcttagttgagggcacctaggattaaagtgactttctcatgatgacttttgcctctaattcaatggtttgaggcgctcctttgtcaccttcaatcctttttaatacacgttccatcgccgtcctgcccatatcatgtgacggctgggcgatcgttgtaatgcctggaccgatcagtttgtaccactccgtatcatcgaatcctgcaatccctatatcttgagggatgcgcaggccaagctcttccatacagctgatgattttcagcataatcaagccattcaaagccagaatcgcttttttttgctccgacatttccttgtgaaaagaacgaagcgccgccttaagctgctccttgtcttttacgtcaatttcatgcaatctgacaagcccgttcacattttgaaccgaagccatttcctgatacacagctgctctttctgcacgagggctgatagaggaaatcggttcggtaaacagcgcgacatcagtataccctttgctgtacaccttctgaagaatctcttttgtgatccatctgttgtcagtcgttacggtatccagtttcagatccggcagtttccggtcaattaagattgttggaatttgctgttcagcaaaagcgcggagtacatccttgttttcccctgttgcgtttaaaatcaagccctcaaccgaatgggcttctagctttaagagcatttcccgctctttttcaggactgttatctgtgttgcacaccataatgctgtatccatattgatcacaaacctcttcgactcccctaaaagcagcgaccgaaaaaggatttgtaatgtcagctacaacaaatccgattaacttgcttttttttattttcaaaccttgtgccattttactcggccgataattcaattctgcgattgcctttttaatgtttttcactttttcaggagaaatcgcgtcaatttttccgttaatatagcgggaaactgtcgatttcgaaactcctgcacattcagctacatctttgatggttgtatggcctgttgttttctttttcattcaagtgctcctgtatctcatatatttgaaaccgatttcaaaaccgttacaacaaaagaataccataattttaaaatttgggaagagtttttttaataatgtgtcaattcattattttttcgttgactcttttcactatttatcctaaaattttctttgaaaccgttaccaaaatattttcattcaagtgatgctgaaatcctaaccaaggaggaaatataatggaaaatcgttattctgtacatcctgaacaagtaaaacgctttacaacagaggagcttcgcagtcatttcttaatggattctttatttacagaaaacaaacttacgatgtattactcacatgaagaccgggttgtcatcggcggagcggctccagggcaaagtgaactgaagcttgatgcaggtgattttctaaaaacagacttctttttggaacggcgtgaaatcgggattattaatgtcggccagcctggcgctgtcagggttggcgatgatgaatatgtgcttcaaacaaaggattttctctatattggaatgggcaatcaggatgtatcgttttcaagcctgaacggggaaaaagcgaagttttacttcgtctccgcttgcgcccacaaaagctatccgacacaaaaagccgccctacctgaactgacaccggaccgccttggtgatgatgcagcgtctaatgtcagaagtctgtacaaagtcattcatcaggatggcattaaaagctgtcagctgatgatgggaataacgatgttagatcaaaacaacaactggaataccatgccagcacacgttcatgaccgtcggatggaggcttatctttatctggatcttgaaaaggactcaaaggtatttcatttcatgggccagccggatgaaacacgccatcttgttgttggaaatgagcaggctgtcctttctcccgcctggtctattcattctggcgcaggaacatcaaactatagctttgtgtgggcgatggctggagaaaattacacatttacggacatggatctcgttccgatggatgggctgaaataagatgggttatctacatgacgccttttcattagaaggaaaaacagcgctggtgacaggcccgggaacagggatcggtcaaggaatagccaaagccctagccggggctggcgctgatattatcggcacatcacatacaagcagtctgtctgaaacacagcagcttgtggaacaggaaggccggatatttacatcttttacattggacatgagcaagccggaagcgataaaggattctgcagctgagctgtttgaaaacaggcagatcgacatccttgtcaataatgccggcattattcatcgggaaaaagcggaagatttttcagaagagaactggcagcacgtactgaatgtcaatctaaacagcctgtttattctgacacagcttgctggcaggcatatgctgaaaagaggtcatggaaagattattaatattgcctctctcctgtcttttcaaggcggcatcctcgttccggcttacaccgcgagcaaacacgctgttgccggtttgacaaaatcatttgcaaatgagtgggcagcgtcaggcattcaggtcaacgcaatcgccccaggctatatttctactgcgaatacaaagcctattcgggatgacgaaaagcgaaatgaggacattttaaagagaattcctgccggccgctggggccaagcggatgatatcgggggactgcagtctttttggcatcacgtgcttcagattatgtaaatggacatattttagcagttgatggcggctggctatcccgctgacaaataaaaaaagctgacgaacgatcgtcagcttttttccattacatcatgtgcggttcaacaggcaagacctttttgacctcatcaatgatgcgttcattttctccgccagcgtaaatgtgaatcgagccgctgtcttgattcgagcgaatcaggcgcccgatgccctgccgtacacgtaacaacatatatggcagatcaacttcttcgaacggatcttttttcgctccgttgcgcttcgctgtaaatacaggatcgtgtggcgggaacggcaatgaccaaatggtaacattcttcaatgcgtcaccgggaatgtcgagtccttcccataagtgaactgaacaaagtactgtttcctcttcctcttggaatttctctactaagctgctgatttcctcatcaccttcgaagaaaattggatacggcagctcccatgccgccgacagctctttaaactcgtttaattcttcaaaagaagggaaaagcaccagcgttcttcctttgtaacgtttgattgtttcaatcgtttcagccgttttttgttcagcggccatatctgtttttgcgtatagattaatactcatttgctcgtcataatcataaggggaatcaacagttaatgacaaataatcatgaatcccaagactgtcggcaatataatcaaacgaaccgccttctgacagcgtagcagaagagaagatataaggaattttcttagaaaacactttttcgccaagtacttctgctaccgttctcggcatcacgacaaaggttgattctgcttcctttttctccagccagctgatcgcatccttttgatatagagataatgaatacgccatttgttcaacatattcttccactactgacagttcgtattgatcaatcgtatacatttcagactcaaatacaagtgcctcaccgattttatcaagtaaacggcaaagctcgtccgccgcctttttgacacgctggtcattttttatttctaaacggtgtgaaccggctacttcctttgattcttcagaaagaacatagaaaaattcgtcgtttgcgagaagcgcatcttcaatcaattctgcaaactcttctctgatgtcattttgcagcaatcgttctaaaaacaattcaagagtagactgcttcactctataggttagcgctttttgcgcagcaaactctaacaaatgcccctcatcaaatacaactgcactatgatcaggcaagagcggcagctggccctctcgtttgcgtgattcttccgtccacacatgctccatataaaaatcatgggaacaaatgattaagtccgttgacttgcggtagtaatctctggaaagtgtcagaccgcatctgtgtctcatatcacaagtcagacagtcctgaaacgagtcgtagcttacgtcagaccactcttcattcgatagatttgcgtactgcttacggtcgccatacggataaaagcgctgcattgcctgtgactcgtggacaaatgacggtaacgactcataaagatccagccatttatcatcatcagaacgctgcattgttttttcaagcttcttcaagcataaatattgctcatgcgattttgacagccttgtatcaattttcagatcaagatgctcagccagcttagaaatatcgccctcttttttcaccagctgttcaattaatgtttcatctgcacaagcgatgatggcgggtttgccgacatatcttgcatagctgattgcaaaaagaagataaaccagcgttttccccgttcccactccagcttcggcgaacatgacttttttctctttaaacgcccgctccagctgaaaagccataaatacttgctcatcccgaagatcaaaccctttttcgggaaggatatcgtaaaacacgtcaccaatccaattgttcaattcttcataaaaattctttgttttcgttaaagaaaaaggcaaacgtgatgttgtcacctagttccaacccccaactattcgacattcagaccaccaataatatcattttccgctgatgaatacaataaaaaaacttggcaatgccaagttttttgcagtttacttacgattgatcacatgcgacgataaaaaaggatggtctgttgaataaatatgttctaccgctttttctaaatcagtttgcgcatgcgaaatcacagacggagacgaatcagtcccgagctccttcagctcgtttgctgttgcgtcaagcgccctttgaataagattaaaatgttcgctgttcagcatgagatcacctctgatggaaataatcatcattgtatgcgaacttttcattttatatacatgctttaccgcatgttatcaccgaaacatgcacaaactacacttgatattccgtctccggattatccgtcttatcaacaatattctatcagggagtgatgttgacatgagttatagaaaccgattagatcagcattctgaactgtttcatcacaattggacgcggcctaaacgttctaagtctcaagtaaacggtcacactgaaatgtcccaaaccaacattatattgagaagcaacgcgaaagctcaccgttggtaacgatagaatagggctgaaagatgaaagaagacgcatgcagagcgtcttctttttatgcgttttctgttttctttcgctgcggtcttacttttgaccagtattgataataatccgttttaataaacccgttaaagagttttcgtttcttcgttgcttttctgccatatgcttcctcaaagttttcatttgatgtcagcatatacacagaccaagtatcaagcggctcgaacgcctgccccatttctttgtacatctgctcaacggcttttttctcgccgagacgctctccatatggcgggttgccgacaattacgccaaattccagatttgtggtaaagtctttgacctgcatctgcttgaactggattaaatctcccaatcctgcttcctctgcattttcttttgcgatttgaaccatgcggtggtctatgtcgctagcgaaaattgtaagcggctgatcataatttgccttttcttcgacttcaagccgcgctttgttccacagatctttaccgatccattcccaatcctctgatacaaaatcgcggttgaatcccggggcgatgttttggccgattagcgccgcttctatcgcgattgttccggagccgcagaaaggatcaacaaacgggcggtcaggcgtccaattggttaattgcaccaaagcggcagcaagtgtttctttaatcggcgcaccgccctgatcgacacggtatcctcgtttgtgaaggcccgtccctgatgagtccagtgtaatcaaagcctgatctttcaataaagatatttccactttatactcagcacctgtttcttcaatccaatcattggctttgccggactgcagcttgagcttttcgacaattgcttttttgacgatccgctgacagtcgggaacgcttgcaagtgttgattttaccgattttccgatgacagggaatttcccgttttcaggtataaacgagcgccagttaatcgctttcgttttttcaaacagttcatcaaatgttttcgctttaaaagaagcaacctgaacctttatgcggtcggctgttctaagccaaaggttcgcacggcagatggcaagtgcatcaccttcaaaaataactttcccgttatcaaccttgcattcgtatcctaaatctcgtacttcctttgcgacaacagcttcaatgcccatcggcgccgttgcaattagtgtatacttcttcatcgtatcaccctgtcttttaaaacttttctcttttcaagataaaagctctccttatacgggagagcttgttttcatcattttaaatgtaagtggtctaacgttctgtaagccatgttttgttccgtcgtactgcaaacggctcatcacctcgtactcaggcggcaatcatctatctacagaaagcattctgtccttctctccgttgaattccgttaagaaggttcccctaccaaaatttgggtttctcgctcgaggggtttaccgcgttccactctcaccatttctagtgagacttcgtcactgtggcactttcaaggatactcagccatatccgaagacgtaggcttttttcctgccgtcagcctctaaagactgccctagcttatgacttcgctaggcacgaacactacgggcatctcagcaccgtgcgagcatggactttcctctacagattcaagatctgcagcgattacccgaacgttaagaacatgaattattatataacaactgattacaatttacaagcgccatttttttcaagcgtgatcaatcataaagcttgctgccaaaaacgtgtttttctaagttagacagccgttttaaaatatcaaagtttgttgtgttagattgcacaggctgttttttgctggcttcttcaagctgttttttcagctgcagattttcctgctgcagttcttcaatttcttgatggaaggtttcataatccttaataatcatatctaaaaatttgtcaacgtcttcttgcttgtagcctctaacgcctgttttaaattctttttccaaaatttctttcgcagaaagctttactttatcagcaagcatctttttcacctcgtatcgtgaatcatcacatatattttttcagaaatctgtacggttgtcaaatttctcttattgctatgagtagctgtcttcctctactgtcactctcaagtcatccattgtaataaagtagatgggatagccattctgttcgcgccttttttccgctgtcccaagcatatacttaggggagccttccttttccgggtcatataaaagcagaagcccgtcggacttatcaatgaagaactgatttttttgtttgaattgaagcgggctttcataaggacggtgagtcaggcttgcttcatagtctgcctgagccagaactgcttcatactgttccttattcggttctttccagttcttttcctgctcgtaaaatggtgtgatgacagctacctttaagtcagggtattcttcctgcaaatcatatgcggcttctgccgcccacagctctgctccaagctggcccgaaattaaaatccattctaatccttcatccaaaaaagcaatcagccggttcttaatggctttttttatgtaatacagcgccttgtcatcctgcttaaatatcccgagttcaaacggtttatagcccgttattgccaatactttcatcatttcacctgctttaaaaaatggggctcccgtgggccccatttgttgtgctgcattgtttacaccatcaagctgcacgttttccatactagtagtcgcagcaaggttttcctgcttgaaaatgctgatgcgtagccgggtcaacatttgagaaagtgtgtggaaagtagtgaacgtgctgaaaatgctggtggtttacgtttgttgtatgctgtgggtgaatgtgcggcacgatagtcttcgaaaacgtatggtgttcacagcaatgagtaggatggacaattggcgccatcatatgcggtctgcagtgatgcatgataaaatcccctttccataaactttattacaatactaagttatgaaaaataaggggtacatgttctgatgcaaagacctattttaaaagtgtgcaattaagctgtctttaaagtttgaaaacacaaaagcaatcaaaaataccacaacaaagaacaagtaaaaaacacccttatacataccaactctccctttaaaaataactaacgtcattttacaggattcgccgctattctacaacaaaatcaatgtgaattcagcaaaaaaaattcatggcgaaacaagtcgtcttttgcgctttcccggggaatattcaagaggaatatttcctctttagccgggcaattctcacatgcagtttttcagtttctttctctgataagcatgccgcatcgctaagcaattgctctgctatttgcaatgcttttccgaattcttttttcttatgctcaaaatatttcgcgagctctattacagcagcgtatctgcacttctggttttgcgagcgggacagcttttcccaaagcggcactgcttcttccaagcggttttgttttttgtacaggagcgataaatccagctgtgcactgtcctggtcctcaaacgatttttctataagcctttccaactgcttgatcgcttggtccgtttctttatgagccataaaccatttcgccatagcataggcttcactgtgttcttttggcgcatgtgattctgaaaggatttttttagacatatggatgtacaatgaaatgagcgataacacatccatttcattatgatgcaggacaccttttaaaagatccggctcttgcgcctttataaaatgaaagtaaagcattggcgccaagtagcccggtgtgtcttctagtctgcggattccgagctcctctttttcaaccgtgccaagagatacgcggtccattttgtgtttccacaggcgtctagctccatgcaaaagatcaaagtggccaaattccggaagcttcggaagtctgtcacggatcaaggtgtgtcttgttttcacctgcggccaatcaaaggctttgccgttgtaggtcacaagtgatgtaatgtcaacctcgcttaaaaagctttggtacaaggcgacttcgttccccggtttgggcaaaagatgctgtttgactgtcactcggtcttcatatactctcgcatgcccaagcaaaaaaatggtattcccagctccacccccaagaccggttgtttctgtatcaaagaaaaagaggttgtttttgttatacccttttgctgacaatgtatgcgacaggccgctttgattccacagtgtgatcacttcctcaagctcagaaaagctgtataacccatggcggtgagaaagcggatattccacttctctgataaggcagtattcatcttcgaagatgaaaggcttcataccaaaagcctcccactcttctaaaaacgggatgtcatcaaagtggttttcttgtttgcctgcttctattttttgttctccttcatcgagcaccatgtgctttttcatccgctcgagtttcccttttaatgacatatccggcctccctccttacgacatttgatccaacagctgcaaaattcttttctttgcttttatcccttctatttccgtacctatacaagacggacagccgtcatgacaaggacaatgtgtaatcagttgtttcgccgcttcattaatgtctgaaaaacgtttaaagacttcctccgccaaaccgataccgcccggataatgatcatataaaaatatggttggcaatccggtatgggctgctttaatttgagaaacaacatgaacatcatttcgatcacacatgatatacacagggacaatatgctgcagcacattcgagatgccaagaagcagctgttccagtgtcttttccccgatgtcttcatccgctgttttgattttgagccaagctgcacttgtatgcagttcttcttccggcaaatgaatgggtccagacccaatattttcaaaagtggtcatttttatttttttaaaaatggtcggcagggcattgacagtgacgtctccgtagtgcaatgacgtacggcttttttctttcgttttatcgatttctaataccttcagctgaactgccaggtttgcatccgtataatattcgacatcgacttttctgacatatgcttttttatggtcccaatcgagcttctcaacttgatactgaacgccttcatgcaaataaattgcttcatcatgtaaaagcgtcatcgcgctaaaacggtccatttcaccgataatccttacatttgcaatatccgactgatcaactataacgacattttcctgggaggcggaacgcaaactgatgtttgaagcaggaaacgactcacttgcccaatggtaccgttcgccgttgcggtgaagaacagcctcttcctgaagatactcaagaatatcactgacttccatggctccaaattcttcatcagctctaaaaggaagctcataagccgcacactttaagtggtctactaaaataatcaaattctccggattgattcttgcagattccggcgaacgattaaagaaatattcaggatgccgcacaatatattggtcaatcggtgttgaattggctaccatgataatcaaagattcaccgtgtcttctgccagctcgtcccgcctgctgccaagcacttgcaacacttccgggataccccgtcattacacacacttgcagctggccgatatcaacaccaagctctaaggcattcgtactgaccactcctaaaatgtcgccttctctcagtcctctttcgatttctcttcgctctttcggcagatagcctccccgatagcctctgattgattttgttccaatctcttttttcacaagctcctgaatatggcttaaaataatttccacccgaactctgcttctggcaaaaacaatggtctgcactttgtttttaaggaactctttcgccagttcattcacttctgcggttgcgctccttctaatattcagcggtttgttcacaattggcggattgtaaaacacaaaatgcttgcgtccgctcggtgcgccgttgtcatcgaccagccacatcggtttgcctgtcagctgctctcccaattcctttgggttggcaattgttgcggaagtacaaataaaaaccggatcacttccataaaaccggcagatccgcttcagccgccggatcacatttgccacatggctgccgaacacacctcgatacgtatgaagctcatcgatgacgatatacttaaggttttcaaacaaactgacccatttcgtatgatgcggtagaatggcagaatgcagcatatcggggtttgtaatgacaatatgacctgcttttctcaccttttgtctgattgccggagacgtatccccgtcatatgtaaagcttttaatatcaatgcccatttcatcaataatttcatttagctcgctcttttggtcttgtgccagcgctttagtcggaaataaatataacgcccggtttgtttcatcttgggcgatggactgcaggactgggaggttgtagcataacgtttttcctgatgctgttggcgttacggtaacgatgctttctcctttttgcacatattgaaaagcggaatattggtgagtatatagttcatcaatgccccttttcgaaagggccgctttgattctctcgtctatactttcgggcataggccttgtttttgcttcccgaggctcaatttcatgccaattcacaacgttttcatttccttttaaatcagaaatgagttcagtcagtgatttctttttcattctttacacctctttgtcaagtacagtttaccgaatatttgtttgcatggctaggtgcaaattttatacagttgaataaaaaaagcaaggcatacgccctgcttatttcgcttttattgtaaggagctttgattcgcctttacgagcagccttttcgcctgccggcacaattgaccctacagcctcaccattcattataacgattgggatgactgtgctgctcgctttttcttttattaattccaaatcacatgtaatcagcgggtcaccgaccttcactttatccccttctttaatgtgggcagtaaatccttctccgttcatattgactgtctccagcccgacatgaattaacagctcaattcccgagcgagtccgaatgccaacggcgtgtttggtgtggaaaatctgaatgacttcaccttcagcgggagaaacgatttcaccgctagaaggttccaccgctattccttctcccatcattttctgtgaaaaaacagggtccggtacatctgacaggtccattactgtaccgtctgccggagaataaataacctcttctgtcaccttttcctgagttttgcccattccgaataattttttcagcaatgtattttctcccttctcattcacttcaaccgttatcccttcattcaccactatttaaccacactttcaattttgcttcaatttataacaacatctggcatagacgcataatctggttaaaaaaggcggtggcgaaattggaattccatgatgacaaaaagaacgaactgcaaaagaaagaagaaatcataacggaggcaatcgacactcttttccaatcctcagcgttcggcaaccttataaacggatttcagaacctgatcaactcgagtttaaaggatgtgcagacgaccatacatgtcagagaaaaagatactgggctgtatatcgatattaccattccggcgacgtttcgagatggcgagatcgtcgttgatgttaaatcgaggtatctccatgtaacactccaagaaaaacagaaacaccaaaatgaggctacctttacaagcatgacaagaacggttcagctgccttatgaagttcgccaagaagatatggaaacgtcttggaacgagcagacaatgacacttttctttccaaaaaataagcatgaatgaacgattcattcatgcttctatcatttaaaaaagctggtaaatccctttattaaagatccgacctgattcattgcactcattacttgacctgtcgtatccatcattttattaaaatcaaattgcccattggcttttttgaactgcgacataatgctttgaaattgcgaaggctgctgttgattaggccttgggataggataagggttagaaaatacaggcggctgcataggcataggctggatcggagcatagggctgataataatcctgctgtccataatgctgctgaggcagttgttgctctaaataaccgggtgcagcctgctgataatatccttgcatttgctgaggataataatagcccatttgccgaggatagcttcgagagctcctgttcattgcgattcccccctaaacacaacatatttctcttctatatatgtatgaatgacttctattgtttgtgtcacaagtgatgattagcatttgtcaaattgtgtcgaaagtttaaattttttaaaaacagaaaaaagtcgaatcattatggtaccatattttcaatacagatgagaggggatgcaccataatgaacgtatcatacttaagcaaacgttttgcagaaatgaagaaatatgaaacagactgtatgaataaactgatggactttgccaagttcctctatattcaaggacatctcagcataactgagtttcgtaacagtatgaaggttctcgaagcaaatggagcagaaagcccggcatatgagatgaattaacgtccggccccctataaaaacgaaaagaagacagccttttaccggctgtcttctcttgcaatttcatcctttactgcgtgcaatgtataaaggactgactcagtgatgtccttgaatcgttttttatgaatatgatgaacatatgattgaaggaccaattccaggaaattatcttttacggtctcaatttgctctttatgcacatattttggccggtgggcttttatcaattcaagagcaccctctgcccagcgggccgccagttcatcattctcttcaactgcaggctttatcgtctcaaaaaaatcataagaatgattactgttttttccttcctgataccgatcagcgcctttttcagcaacttcaatcatttgctcggtcatttccagcaatgtttgtgatagcaatacctttcacctcaatgcttatcgtaccaaatttcactcacaaattcagccgatgcggtataccttctcaaacgcatacctgtgttcaggcgattgatacagctcatttatacaaatatgaagatctatgatttcttcttcaagcacacttaggcgatcgttttccgtttcccgcatctcagcctctaatgcatttacagaatgattcaggctttgctcagctcgcgttaattcatcttctatatcagaaagcatacggagaatatctgtcttgcatacataaccggacattcgtgtacctccctttccttgtctctcccggttaaaattctttgctctcaaggctctttccttcctcatgacaaaactagaagcaaatcgccaaacaaacaggtattccacgaaaagctgaagttttcgacaaaaacacccgcaaaaattgtatgatcctcctccttaatgcaaacgatacttgtgaggaggtgccgtatgaaaacaagaccgaaaaaagccggccagcaaaaaaagactgaatcaaaggcaatcgattctttagataaaaaattaggcggcccgaaccgcccttctacgtaagaagcaaggaatttccttgcttctttatttttttagccactgctccaccgcaaaaagcgcatgaagctggcgctttttatgtaaataccagtctgtcaattcaatctgcttcggcaattcctcgcgcctaaagaacgttttctttatctttccatgaaaccaatctgttttcgttccgtctaatgagtggattaactcagggtagcatgtccttagcataggagatgttctttttgtaatcccgatcatcttttccatatcaaaacgggaacctgtgtgcggcactgtgtgcaaaaagtgataaaaagaggagaacaattctggcttgaacagcaattgagacagctgctttcccagccttatcctttcctccgcctttgaaaagcgtttcactgaaatgccgtaaagaaacccatttgaggaaggaaaaataacggtgttaaaatgaaaccagtcacttaaataaaaaggaatcgtgtcaaaaacattctttttaaacgaaggattttgtataataggtgtttggatagtgttttgttcatttataatgagggcatacattagccgctccgtatttcgctcatgccaaaaacgggtccattcttccgacataaattgtgagacgccaaacacatgcagaagatgaaacagcggtttcccgactctttttgaccagtggtatagtagaagctgcggataggcatccgaaaaaataagccagttcgctctttcataggctaaaaagaaccatttttgctgtctctcacggagtccaagctgaaacagactgccttttaagtcagtcattgaccagccggcattacgagaaacgaaagaagccaaaagcgaccatttgatttccggatgacggtcgtaaaatgctttataagcatttgttcttgaaatgttatccgcgtttttcatttttgtctgccgctcaatccggctcagaagctttctgatggtctgttgttcttgcacgttcattcacttccgtcatgattagtttaataaggaggatgagaaagtgattcggtatcctaacggaaaaacatttcagccgaaacattcggtttcatcccaaaacagtcagaaaagggccccgtcttacagtaatcgcggaatgaccctcgaagatgacttaaacgaaacgaataagtattatttgacaaaccaaattgccgttatacacaaaaagccgacacctgttcaaattgtaaatgtccattatccaaaaagaagtgccgcagtgattaaagaagcttactttaaacaatcatcgacaacagactacaatgggatttacaaaggacggtatattgattttgaggcgaaagaaacgaaaaacaagacctctttcccctgcagaattttcatgaccatcaaatcgagcatatgaagcaggtaaaggctcaagacggtatttgttttgttattatatccgctttcgaccaggtttattttttggaagccgataagctgttttatttctgggacagaaaagaaaaaaacggcagaaaatcaattcgaaaagatgagttggaagaaacagcttatccgatttctcttggatacgcacccagaattgattatattagtattattgaacagctttatttttcgccatcatctggtgcgaaaggttgattaacgaaaggttgagatgttatgtcagatcaatttaacagccgtgaagctcgacgaaaagcgaacagcaagtcgagtccttcaccgaaaaaaggcaagaaacgaaaaaagggcggattgtttaaaaagacccttttcactttactcattctgtttgttttaggcgtagtcggcggtgctgttacatttgccgtcatggtttctgatgcgccgtcccttgatgaaagcaaattgaagacgccttattcatcaacgatttacgataaaaatggaaaagagatcgccgaagtcggcgccgaaaaacggacctacgtctcgatagatgaaattcccgatgttgtaaaagaagcctttatcgcgacagaagacgctcgtttttatgagcaccacgggattgaccctgtccgtatcggcggtgctttagttgccaactttaaagatggcttcggggctgaaggcggaagtacgatcacccagcaggtcgtcaaaaactcccttctttcacatcagaagacgttgaaacggaaggtgcaggaagtatggctttcgattcagctggagcgcaattactctaaagatgaaattttagaaatgtatttaaaccggatttatttttctcctagagcatacggaatcggaaaagcggcggaagaatttttcggcgttacagatttaagcaaattgactgtcgaacaggctgccacactggcaggcatgccgcagagcccaacagcgtataacccggttaaaaatccggataaagcggaaaaaagacggaacatcgtcctcagtctgatgaaaaaacaaggatttatttctgattctcaatacaacaaagcgaaaaaagtggcagtgaaagacgaaggcgtcgtgtcacagaaagaatatgaaaaagcaagtacaaacaaatacagcgcatttgttgaagaggttatgaaggaaattgatgaaaaatctgatgtcgatccatctgctgacggattaaagatctatacgacattagatacaaaagcacaagataaactagatgaattaatggacggagacaccgtcgggtttactgaaggcatgcagggcggcgttacccttctcgatacgaaaaccggagaagtgcgggcgattggcgccggaagagattctacggttggtggctataattacgcgacccaagcccagcgacagcctggatctaccattaaacctattctcgactacggtccagtgattgaaaataaaaaatggtcaacttacgagcaaattgatgactcagcttacacttattcagatggaacacctattcgagactttgaccgttcctataaaggggtcatgtctatgcgtgaagccctcgcccaatcacgtaacatcccggctctaaaagcattccaagcagtcggaaaagatgcagcagttgattttgctaatggactggggctcggattaaataaagaaaaagtgtatgaatcatattctatcggaggattcggagaaggtaatcccggtgtctctactctaactatggctggagcatacagtgcattcggaaataacggaacatataacgaaccgcattttgtgaaatcaatagaatttaatgacggcacgaagcttgacttaacaccgaaatcaaaatcagcaatgagcgattatacagccttcatgattacagatatgctgaaaacagctgttaagacaggtactggacagctcgcccaagttccgggagtggaagttgcaggtaaaacaggtacaacaaactttgatgaagcggatatgcaaaaatacaatatcgcacaaggcggtgtaccagattcatggtttgtaggatatacacctcaatataccgctgctgtttggacaggtgtagattctcaaaataagataggaaaaaaatctttaaataaaacagagcaacagattgccaagcgcatcttcgcccagctcattgccgatgtcgatgacggaagcggatcatttgagaagcctgacagcgtagtggaagccaccgtagaaaaaggttctaatccggcaaaactggcagggccaaatacgccaagcgataagaagctcacagagtactttgttaaaggcacagctccttctactgtttctaaaacatatgagaaagaagaaaaagaggaaacagctaaactgtctggtttaaacgtgaaatacgataaagacaatcaatctttaacgttaagctggaattatgacggagatgcgacctttgctgttaagcaatctgttgacggcggcagctactcggaaattcaaaacagctctgcaaaagaggcagtcatttcgggtgtgcagccaggatctgtgtacaaattcgaggtaacagccgtcagtgatgatggcaaaagtacagcttccacatcttatgaggtgccaaaagctgaagacgatgaagataaaaaagaccagcaacaaacggatgatgaaaaacaagatgatgagaagactcaggatgatacacaaactgatgattctcaaaaagatgacggtaagacggatcaagatcagacagatgattcaacaaatgatcaagacaaaaatcaagacaacacgaacaccaatccgtctgacaacagtaaccaagaccaatctaacaatagtaataacaataacagtaataaccaggatacgtcggatggtgattcgaactcagatacgaatgactcaacaggtactgacacgaataaaaataaaacagacacatctaataaaacacaaacaaactcatcatcaattgaaaaaacaaattaaccaaaaaagccgtcacctttggggtgatggcttttttggtacacaataaaaaacctcccgttttaacaggaggttttatcgattcatcgcatgatatttataaaaatgctttttcatttcggtaatcagctcatcaagctgaataaagcaatggtattgggtcggcttaagaagaataaattccactcgttcagcccaattaatcggctttgcgggatatgatttctccctcagttcttgccaatcgagcgatttcaccggctcacctgctgtccaatgtaacgaagccagcaaacacacaatgccctttaacatttcgttttggtcacatctcgattttcgtgtttgaaagactgggagaagtgatgctttgatgtcatcccacacttcaaataaaagcggaacgtatttcccgctgtcctcccatggcaaatcgccttgtaattccgtgcagaaatcaaaatacacgggattggtctgcaaggttttcttcatatccgaggaactcttctggccaagactgcgcaagtattgctcataggaagccaacacttcttttgcttgcgtcatcgtttcaccagtccttttttatccctcttctgcccttctctgcacaaagaaagcagcggacactccgcacagcgcggagattgggctttacagtgatatctgccgaagaaaataagccggtgatgcgtaacggaccagtcttctttgggaaccttgcgcatcagcgtcttttcaacttccagaaccgagtccttccaccggcaaatgcccaatcgtttgctgactctctccacatgggtatctacggcaatggccggcacgccaaacgcaacggataccactacgtttgcggtctttctcccgacccctggcagtttgacaagctcatcgcggtctctcggcacttctccgccgtaatcttcaataatcattttactcagcttttgaatatttttcgctttattacgatataaaccgattgatttaatatcctgctgaagctcttccagcggaacagccaaatagtcttccggccgtttatatttttggaataatgttttggtcactctgtttacaagtgcatctgtacattgcgcagataaagctacagccaccactaattcaaaaggattggaatgaaccagttcacactccgcatgaggaaacatgtcacctatcttgtctaaacagaattcaatttgttttagatttaacacgattgtcaccttttcactttattgttcaagccaattgtaaaaaggaacctgccttttatactctttttgcggttcattctgctttgcttgtacacgccggaatttttggctgtgtatttttgcttgctccacagttttaagcccgtttttcttccattcaaacaaaatccggtcaatgtagcggaaactgagttttcctgatagtacagcctcttttaacgcgtgtttgatcagttgtgcgtcatgctgatcctggtcctgccagatcgccagcgtttcacactccaaaggcgataacggccttgcgaactcttcctcaaaaatggtataaaggcttttttgttcccttctgcttttctttcctgtgtttgattctgtgcaagctgaatatactcgtacagcttgccccataaaggctgaagagaatatttctcaaatttgatgccgttttgatcctcgcattcttcaataaacagaaagcctttttgaataaacatccgcaatctgtttgtgcattcttcaacagaaattgacataccttcctgcagctgattcggtgtaggaaaatatgatcctttttctaaatgcattttaatttttaacagcagaataagttctgtttcattaagcccaagctgtttataatgcgtaagcagaagattggggatggttgatgttccctgctcctgcatatcaataaattgctgttttttcatcgtcacacctcttactgtaaaggattgtgattgcccctttactgtaaaaagtctcccttgcaggagactcttttttgtttcatttgaatgtattacggatacagacggtttaacagtcttgggaacggaatcgtttcacgaacgtgaggcgctccgctgatccaagctactgtccgctctaatccaaggccgaagccggaatgaggaactgatccatattttctaagttcagcataccatttatatgcgtcagaatccagtccatgttctttaagacgcgattccaaaagttccatatcgtgaatccgttcagacccgccgatgatttctccatagccttccggcgcaatcaagtcagcgcaaagcacaacgtcctcacggtcagaagccggctgcatatagaacggttttaaggacgtcggatagcgagtgatgaataccggtttgtcataatgttcagcaatcgctgtttcatgaggcgctccgaaatcatctccccactcgatatcgtcaaagcctttttctttcagaaattcaatcgcttcatcatacgtaattcttgggaacggagctttgatttgctcaagttttgacgtgtctcttcccaatgtgtttagttcaattttgcaatttttaagaactgattgcacgatgaaagaaacgtaattttcctgtacttgaaggttttcttcaaattctacaaacgccatttccggttcgatcatccagaattcgattaagtgacgctttgttttagacttttccgctctgaatgtcggtccgaaagagaatacttttcctaaagccattgccgcagcttccatgtagagctggccgctttgagacagatatgcatcttcatcaaagtactttgtggcaaagagttctgttgttccttcaggtgcgcttccagtcaaaatcggcggatccacttttacgaagccttcgttattaaagaattcgtaagtcgcgcgaatgatttcattacggattttcatgatcgcatgctggcgctttgaacgcagccataaatgtctgtgatccatcaaaaattccgttccgtgttcttttggtgtaattggataatcggtcgcttcgtgaatgacttcaatatctgtcacagcaagttcatatccaagcggagaacgctcgtcctctttgacaatcccttttatatagagcgacgtttcctgcgtcactgatttagctgtttggaaaatgctttcttccacttccgcttttactacgacaccctgaataaaaccggtaccgtcccgaagctgtaaaaacgcaattttcccgcttgaacgcttattagcgacccaagctccgatcgttacttcctcacctacgtgcttgtacacttggttgattgttgttttcaacatatttccctccaaaacaagaaagacattcggaagctcattgccccgcgaactcttttatcatcactttattatacccgctcttaactaaccgggtcaatgcagataaaaagcggcttttctgtcagccgctttttgatctgttagctatgtttttctacaaaacgcttgattctttcaatggctttttcaagaagatctaacgatgttgcataagaaagacggacattctcaggagagccaaatccggatcctggaacaatcgcaactttttcctcctcgagaagtactttaacaaattcatctacatctttgaaaccgcaagattgagctgcctctattgcattcgggaacaagtaaaaagcaccttccggcttcacacagctgaaccctgggatttctatgagctttgcatagatcgtgtttaatctatgttcaaatgcttctctcatttcttccaatggctcagaaggcccgttataagcagcaatcgctccgtactgtgcgattgatgtcgggtttgacgtactgtggcttgcaaggttcgtcatcgctttaataatgtcttcagagcctgccgcataaccgattctccagcctgtcatgctgtgggacttcgatacgccgtttataatgaccgtttgttctttcagtctgtctgacagctgtgcaatggaaacatgtttctttccgccgtatgtaagtttttcataaatttcatctgacacaatcaagatatcatgttcaaggcacacttcaccgagtgcagatagttcttcttccgtatacatgacaccagtcgggttgcttggagagttaataacgattgcttttgttttttccgtaattgcatttttcagctgctcaggcgaaattttgaagtgattttcctcaagcccttctacataaacaggctttccgccagcgagtttcacctgctccggatagcttacccagtaaggcgttggaataataacttcatcttcttcatccaaaatcacttggaaaagggtatacagagcatgtttggcaccagtgcagacaataatttgagacggtttgtattcaatattctggtcgcgtttaaatttctctgcaatgctgtttttcagttcagccaaaccaccggaaggcgtgtatttcgtatggccctcgttcatcgaacgcacagcggcatcaataatatgctgcggtgtattgaagtcaggttctcctgctcctaagccgatgacatcatggcctgcggctttcagttctttcgctttcgctgtgattgccagtgtggttgatggtgttaatgcggatactctttttgccagtttcaacttgaactcccctaattcgtcttaaggcgtgatatttttgagaatctttccagttgtaaagtccacataacttaaactgtattgcccttctttgtctaagtacgtcacttcccaaagcaggacgtttccttctcttgccagatgaacctctttttgctttgaaaccagcccttcatcctttatgattttcgccgctttgtcttcagagattccctctttcgcttcttttgagagaatttttgcttttttatcagcaggaacccagacatataatgcagtgccttttttatccgttccctttacaacataatatttttcttttccgacaaatgtttcgacttgatcaacattggcgagatcggtttcttttttagcttcagcagctgctgcttcgtgcccctcttccttttgtgccatggctgatttataaatgcttgccgagacaagaagtactgctaaaaaaataataccaaaaatgacggtaaatattaatgctttttttctcatcttctcacctacgtacgataaatggtaaaaacggcttggtttttgttttcttcatccagcgcaaggccgaacatcagattgtctcttttcagtgtacgattcaatgtgtccacaattttatacagatcatcagaatgctctacattaattgttgaaagaatttcgattttactttccattttttcatcctccagtttgaacaaatattgttagtcatactccatttcaggacacgccatactagtatcacagagcgggaaatccgcttttaaataaaacaccatcctactcccacaccgcaaaagccgctttatgcggcttttattctttttcccctgcaacataagcttcaagctcgctgtcagtcatttcggatactgaggttgtcggcaaggcatcaagaaacagccggccgtaaccagcggttttaatccgtctgtccaatatcataatcgttcccttgtctcccgcagaacgcagcaagcgtccgattccttgcctgaaggtcagcacagcttccggtaatgacactgtttgaaacggattctttccttttttgcgggcaagctcacattttgcagcatgaagcgggtgatcaggggaccggaatgggagcctcacgatcattactgtcgtcagctcatcaccagggaaatcaacgccttcccaaaaatgatttgttccgagcaggatcgcctgattggatgttttaaaagtcttcatgagtttgccgggacttccgcctgtaatcccttgtgccaagagctgaatgccggaagcactcatgttatgcttaagctcctggtgaacctttttcagcatatcatgggatgtaaacagcacaaggattttaggctgtttttcctttgccatcagttcgatataacgggctgtatcctgtataaattcaggttgccctgtatcctgaattgatttcatttcctttggaatcatcacctgcatacgctcatcgtaagaaaagggtgactcaattctcattgtccgcgggaaaaagtcactcagtcccagtcgttcaatcataaattgaaaagaaccttcgactgtaagagttgcagatgtcagcaccacactatttttgcgcgcgaaaaactgatcagccagaagttcaccaggttcaagaggctgtgcgtaaatggccactgcatttttcgcaccctttgcatctatttcaatccaaaccgcttcatcgtcatcagacccaaagaagagcttctgcaacgtctgacagtaatgctgcaagcctttcatgcttctttggtattcatcggctaaaaagacggttttgctcttcatacccttcaaatgtttttccatcagggatgactgcgcctcaaaaagctgctgcaaatgtgtcagcatggaacaaagcctctccgcaccatccgttaagatcgaccagcttttatcctggctttctttgttcaccttaaacactagacggtttaagtcttctttaggttttcttcgtttgacaaaagaatgtacagagctaaagaaagcatcactttctgcttgaacgtgctgaagccactcttccaattcgaaaaatgaatcaaccggcaggctgtttcgctggaatagctgtctcatcttttttagaagtccctgctccttcagagtgccgattctgctcaatttcgtatgcaattctatgtacgtagctcttttccctaaatgttcgcttgccgcacgttcaaaatggtgtgcttcatcaataataaatgtgccgctttcgggaagcctttttttctggctggcttcatcggtcagcaaaagggaatgattggtgatcaccaaatcggagcgcatagcaatctgtttggctcgctcgtaaaacccgatcacatgctcactgcgacttcttttataggagtcatcgtcataagccaatctgtcccacagcaattttccgcctgaaggcaaattcagttccgctacatctcctgtatttgtctctgtcagccaaacgagaagctgtgcctttgtcagtacagcatcataattatcatcttcttcatgaagcacctgctcaaatttatacaggcataaataatgcgattgcccttttaaaatcgccgctgttaccggaaatggaaacagatcttggacaatcggcaaatcctttgtgagaatctgctgctgtaaaagcgtcgaatacgtgctgattatgaccggcttttttgatttcttggcaaaaagcgcagccggaataagatagccaatcgtttttccgatgcctggaggagcttcaatcagcgcatgctcacgattggcaaatgcatcagccacctctctcatcatcatcatttggccgtctcttttttcatacccaggcattaactctgacagcgctttttcatttcccgcttcccagctttcgatctcaaatgagaagttctcgtcctcatttatacgagcatcgatagcttcaggttctctgacagaaaacgaagaaaagcgcgtatagcccggtatctcggtatgtctgttttcattaatgaacatatccaacaaatgcgtcagatcactgatgaaatgctgcgaaagccttcttaactgctttaatgtcggataaggaagctgccgcagcttttcaaggatttccaaaaaaataagccctgtcacttcagcatcgctgtcagcccggtgcggctgatcatgccgcagctgaagctcctcgcttaattccgtcagcttatacccttcaaatcccggaaaaacaatgcgtgagagctcgacagtatcaagcacttcacaatctgggagctgaaagcccgccttatgtagctcatacttgacaaatccaaggtcaaaatggatattgtgagcgacaaaataagcgccgtcaagcaattggaatacttcttcagcaactgcttcaaatggctgttcattttctaccatttgattagagattccagtaagctgctcaataaaagcagggattgatttatttggattaatgtattttgaaaaccgctcagtaatttgtccattttcgattacaaccgctgcgatttgtatgattttatcgcctttcttcggcgaattccctgttgtctctacatctataacaacgaaccgttgcttattcattaaaatggacacctcaattcttgcatacgacaaaagtgtaacacgttttgtacggaaatggagcggcaaaaccgttttactctcaaaatcttaaaagaaaaccccgataaagggggcttttcttctacaaaattgtacgggctggttcgtttcccagcatttgttcaattttgttttgatcattcagaacagccactttcggctcgtggcttgccgcttcttgatcagacatcattttgtaggaaataataatgaccttatctccttcctgcacaaggcgtgcggctgcaccgtttaagcatatgacaccgcttccccgtttaccaggaataatatacgtttcaagacgtgctccattattattattcacaatttgtactttttcattaggaagcattcccacagcatcaatgagatcttcatcaattgtaatgcttcccacatagttcaggtttgcttccgtaacagttgccctgtgaagcttgccgctcatcattgttcgatacatattatattctctccatttctcgaatatcaataatgatattatctattaaacgcgcttttgaaaaagcaactgcaacagcgagaatcatctttccagcaatttcattcacaggctcgagttccggataggaataaagctctacatagtctatggttccgctagtcgtttcaatgatttcttttgcagcttttatcaccgcttcaggatctctttcaccggcttggatcagttccgcacttgtttgaagggcccgatacagcttaggcgcttcttttctttcctcagctgttaagtatacattgcgagagcttttggctaagccgtcttcctctctgaccgtatcgacaggaaccaatttaatatccatgaagaagtcactgattaacccatcaacaacagctacctgctgcgcatcttttaaaccgaaataggcacgagtcggcttgactagattgaaaagcttcgtcagtacgatcgcgaccccgtcaaaatgtccttctcttgagcgcccgcataacacgtctgtgcgtctttctacatgaatcgtgacattcttttcaccgggatacatatcatgagcatctggcgtaaataaaatatcgactccggcgttttctgcaagagctgcatcccgctcaatatcgcgcggatatgcttcaaaatcttcattagggccgaattgtgcaggattcacaaaaatactcataataacggcgtcgttttcttgtcttgctttgtctgctaaggttaaatgcccctcatgcagaaaccccatcgtcggaacaaatccgattgacttgccctctgaatggtattgttttatggcttctttcagctgtgaaatatcagtaatctgtctcatcttattttcccccgtacaagccgtcaagcactgtctggttcatttgaaaggaatgcttttgttcagggaaagcacgatgtcttacatcctgaacatatccgctgattgctgtttcgatggtttcatcaatgcgcatatattgctttacaaatttaggtgttctctcaacaccgtggccgataatatcatgataaacgagaacttgtccgtccgctttcacaccagccccgattccaatgaccggtatgcttagcgtctcggcaattttggctgtgagttctgccggcacacattccagcacaagcatcatagctcctgcttcttcgcattttatactgtcttctattaatttttttgcgctttgttcgtctttgccctgtactttatagccgcccagtacgccgactgactgcggtgtcaaacctaagtgactgactactggaatgcctccaagcgtcaatgcgcgaatggattcaaacacgccttctccgccctcaagcttcagtgcgtcagctccgctttcctgaacgatagccgctgcatttttcagcgtatcttccttagacaggtgataagacataaacggcatatctgtcacaataaaggtattcggcgcaccccttttaacggcttttgtatgatggatcatgtccgcaactgtcacaccgacagttgaatcaaggccgaggacgaccattccaagtgaatcaccgactaaaatcatgtcaactcccgcttgttcagcaagtttagctgccggataatcataagcggtcagcatgacaatcggttcttcagactccttcatttttagaaaatccagttttgttttcatgttttctcctcctcatgtttagaggagatgatctgccgttttcttctgcaagccaaaaaaccttccgttacaacgagaaggattcttcactttctaaagttcggcgagtttcatccctctgtcccagtccttttttggatcaaggcagactgctgcaatgtctatctattttaataataggtgcagttcgcaggcgatactgcccaatggaagtataccaaaatcaacgggcttgtaccaacacattagcccaattcgatatcggcagaatagatttttttaatgccttcgttcgtttctaaaagcagaacgccttcatcatctatacctaacgccttaccgtaaaaggttccgtttaacgttctggctctcatattagtgccaataccgagcgcatagctttcccataaaagcttaatcggcgtaaatccgtgcgtcatataatcccggtaccgtttctcaaagcatagtaaaatatgctgaatgacgccggcccgatcaattttttccccagcagcttggctgaggcttgtcgcgatgtccttcaattcatctggaaaatcattaggctgctggttaacgttaatgccgatcccaatgatcactgaacgtacgcggtcttcttcagcctgcatttccgttaggataccgactgttttttttccgttaatcaaaatatcatttggccatttaatatccgtttggatgcctgctgcctcttctattccctgcacaacagctactgcagcaagcagagtcagctgcggtgttttttggagcggaatgtcaggccgcaaaatcaggctcatccaaacgccgtttccttcttgagaatgccaaaccctagacattcggccccttccggctgtttgtttgtcagccaccacgagggtgccttccggtgcgttattattcgcgagctcatgagccgttttttgcgtgcttgaaagaacgtcatagtaaataagatgctggcccatcacttccgtttttaatccaaaacgaatttcgctttcactgagttttccaggctttttgatgagccgatatccttttcttctaacggcttctacttcataaccctctttccgaagctcttcaatatgcttccacacagcagttcttgaacagccgagagcatcactgattttttggccggaaataaattcattgccggcctgagaaaataattcaataaggtcttttcttaatgttgaccgcatgtcttcagccactcctctatgtgtttcttttgattggagagcttccctgtcacaacagcctgctcgatccgctgtaattcttccgacacccattttccagccggtcggtttcgaagcgcaagcaagtccttacccgtgatatcaagatccttaaggcttttgatcggcaggttttgataagcgtactgaatgtccttcagtttcttttcatccagtttttcgttttgccgaagctgcgatattttggccgcagagagcagtgctttttccccagctctgtacattgtcattacgtcaaggctctggccaaacgtatcagcaatgtgaatggcttccttgatcgcttttcccgggagcttccaggctttcaggaaaaggggcgcgtctttcaagactatgccaaggttaattaaaagagcagcccaaagctcctcacgggatgttaaagagaagaatggaaactcactcgttgaaatcaggttttctcgtttatgataaaaaccaggaagctcttcatacaatctcgtttgaatgagcgtttgaagcgcctggcgagaagctcttccctgcagcaatttctcgaactctatagtttttcgttcgactgaaacatgggagaggagtgatttttctttcgcaatggcttcttctgtttccggtgaaagcgtaaagccaagctggctcataaaacgtacggctctcagcatacgaagcgcatcctcttgaaatctatcctcaggctttccaacggttcgaatcactttctgatcaatatctttcttgccgccaaaataatcaagcaccttcccgtccgctgtcatggccatcgcattgatcgttaaatctcttcgttttagatcctcttctaatgatgagataaattgcacttctgacggtcttctgaaatcaacataatcagattcagtccggaatgtcgtgacttcataggtttcatcctcccagagcacaataatggtcccgtgctctttgcctacatcaacagttcgctgaaacagccgttctacttgatcaggtgccgcatctgttgcgatatcgacatctccgatcgttcgtttcatatagctgtcacgaactgcgcccccgacaaaataagcctgatggcccgcttcgattaagatgcggagcacgggaagtgctttgataaaaactttttccatgtgatcactccggttctgctaaatctgcataaatctgttcatactggctgacaattttttgggaagaaaattcattttcaagcatctctattgccgcctttgtaaaacgattgcttagctgttcatcttctaaaatgctcatcgcgcgggctgttgcggccgcaacatcaccgacatccaccaaaaatccgctcacattgtttttaataacctcagggataccgccaatgtttgttccgatacaaggcactccgcaagccatcgcttcaagcaggacaagaccgaagctttctttttcagatagcagcagcttcaaatcgctaatagaataaagctcttcaacacggtcttgatttccaagcattaagacttggtcttccaagccatattttctgataagctcgcaggctgtcgatttctccggaccgtctccgactaaaagcagcttcgctttcgttttgccagcgatattgcggaacacacggatgacatcctgcacgcgtttaacctttctaaagttggacacatggatgacgactttttcatctggtaaaattccatgtttctctttaatcaccgctgtgtttttcttcagatacacgcgctcgtctataaagttataaatcgtttcaatttttttctccggtttaattaaatcgtacgtttcagccgcaagcgctgaggagactgcagtcaccctgtctgatgactcaatagcaaaacggatcagatcttttagagacggatcataacctaacaccgtgatatccgtgccatgcaaagttgtaacaatgccgatattgcgtttcagcatttgttttgcaagataggcgcatacggcatgcggaagagcatagtgagcatggataatgtctaaattctcccgttccgccacctctgcgattttgcttgccaatgtcaaatcatacggaggatacttaaaaacagcatattgattaacctcaacttcatgaaaatgaatattgggatgatatgtattcagtctaaacggaatgcttgatgtgatgaaatggatttcatgtcccttttcagcaagctgcttccccagttctgtcgcaatgatacccgagcctccaacgctcggatagcatgtgattcctatttttagttttctcattgttcgcccccaagcacatcatgatcaagcatcagcatccgtttggaaaagaaaccttcggcatactccacgcccgcttctttaccgtaaagcttttctctcgcttcaacgatctcgatataaccattcgtcagaggagtagaaactgaatcctttgacgggataaactggcttttgtaggcgttgaggctttgttcctttgcctctattgtatccgagatatcaatgacaaaatccggctgatgaaaaccatttatcatataatagtaaaccttgctgactttatgcgccggaaggcttttttcatctttatatttatggattccggcggaaaagatcgcttcttccaccagtgcagccgcattgccgtgatccggatggcgatcctttttatacggcataaaaaccgcttttgggcggcaggttctgatgacagtgacaatcgaccggattgcctgatcactcattattaggccgcggtctggaagcgtcagctgaattcttttatctgcgcctaatatgcgggctgcttcagctgcttcttctttacgtaaactgaccgtaccgttagaagagagttccgcttctgtcaagtcgcatatcattactttttttccctgtttgacaaacttcgctattgtgccgcccattccgatctcgacatcatcactgtgggcgccaaaagcaagaacgtcagcattatacattcggctcttctcctcgaagaaggtcacggaattcgaaaacaccttcatcaagtgtgcggacgagaatttccgcagtacccatatttgtggcgagcggaatggaatacacatcacataaccggattaatgccgagacatccggttcatgcggctgcgcggtcagcgggtcgcgcaaaaaaatgacaagatcgagtgcattggcagcgatcaatgcaccgatttgctggtctccccctaaagggccggattgaaaacgttcaatttgaagacctgtcgcctcttgaattttcaaccctgtggttccggttgcgtataaatcatgattctttaaaatatcccgataggcagtcgtaaattgaaccatgtcctgttttttcttgtcatgcgcgatcaaagcaattttcattgtttatcccccgtctaatcaatgatattttctaaaccgtacacaagctgatcaatcttcatgacttgttcgactgacagtttaacgcctgacatgaaagaagcacggttataagaatcatggcgtatctgaagcgtttggccatccatgccgaacatgacctcctgatgcgcgatcagtcccggaagacggacgctgtgcaagcgaatgccgttttgctccgctcctcttgctcctgggagaatttctttttcatccggatgtccttgctgcttttctttacggacttctgaaatcatttccgctgttttaagcgcagttccgcttggtgcgtcaagcttctggtcatgatgaagctcaataatctcaacatcctcaaaatagttggcagccatttttgaaaatttcatcatcagtatcgcaccgagcgcaaaatttggcgcgatgatggctccgatccctttttcttctgttaaagacgtgagctcttttaaatcagcttctgagaaaccggttgttccgacaactggacggactccgtgctctaatgcaatttttgtatgtacttttccgatttcgggcgttgttaaatcaatcaagacatccggttgtgtttctgtaaagcaggcatggatatctgtgtaaattaaagcatctgactcaacaggcatcacatcagataatttttgctgatcgtatgtatggtctatggccccgacaaggtcaaaatgaggtgttcgttctgccaatttaacagcttcctgccccattcttccacgcggtcccgcaatgactactttaattgtttcgtttgacatcttgatctcctctactttccttcttcttttctggtccagcgatctttatctcttgtattaaatttatgcatgactcggtcgtgagcttcctctaaagagatatcaagagagttggctaaacaaaccaatacaaatagcacatcgcccatttcctcttccatgcttttatcatcttcagtcgctttttttggtttttctccataacggtgattcacttctctggcaagctcgcccagttcttcagtcagcctcgccatcatggccagcgggctaaaatatccttctttaaattggccgatgtaacggtctacttcagcctgtatgtctttcattgttttatcactcactgaacgaaacctcctatcatcctcttacatgttagctaattcagatacgtttgacaaatgtttaagcacgtttgctgttttctttttcatccactataatataaacgctatctaatggaaggaaaaggggttttgtgtgatgcttggagaaattagattaaaaaacatattttttattttaatcggagcggcaattttttcatttggcttggttcatttcaatatgcagaacaatctggctgagggcggttttacaggtattacacttttgctttatgcccttttccacatcagcccctctatctcgaacctggtgttgaacattccgattttttttattggctggcgtttgctcggcaggacaatgtttgtttatacccttgtcggcactgtagccttgtctttgttcctcagcatctttcagcgatatgaaatacatatgccccttcagcacgacttagcgctcgccgctttatttgccggcgtattcatcggagccggactgggtattatttttaagttcggcggtacgacaggcggtgttgatatcatcgcacgtttagtgaataagtattttgggatcccgatgggcagaacgatgtttgctttcgatgcctgcgtcatcattttgtctttgcttacttatctctcctataaagaagcgatgtatacgctggtagctgtatttgtagcggcaagattaatcgattttattcaggaaggcggatacgctgctaaaggcgctacgatcatctcctcgaaaaacgacctgattcagaaaaagattcttgaagaaatggaacgtggcgtcactattttgaaaggacaaggttcctacacaaaagaggatatagatgtactttattgtgtggtgccgaaaaacgaattggtgatgctaaaaagcgtgattaactccattgatgcccatgcctttgtagcggtaagcgatgttcacgatgtgctcggagaaggatttacgcttgatgaaaataaaaatccgcttccgcgctgacatgtaatagaaaaaaggcggctgaccgccgcccctcatccttatttagggtagtccctttttttcagcttgtttttttccgccttgtactttctgtaaccgacataggtaagagcagtaatgatgatactgccggttgtaatcatcacccagagtaaagacggatcggcatcatcctcctccaccctgtcaaacacatttttcaggtcttgctgaagaagggaaagccgttcaagcttcgtgctctctgtcatttgctgaaactcctcttgctcaataacatctatatgttttccgactgtttcaagctgatcctctgatacatcgattgtaagactggggtaaatcaagtcatataaactgataaattcattccatttttcatgaaagcttgtgcttccattcttttggacatctcgcttcagctcagtaaaagcttccataattggtttttccagtgaaccccaaagcgggtcagaccgattgtcaaccgcatccatcagcattctgaactgcgcggctgctctgagtttttgtgtgtctgatgtatcagcttgctttaaactccgaaccatatcattatagcccaatgtgatttgacggatttgggctcccgttagcatggggtcttgctgttttttctcagcggattttaatgttttttcaaaatactccaagacttgaagcgcctcttcatatttcgcctgtcgggtcatttgaaagactgtatcggataaatcattcaattcctcgaggcttccccgctctgcagccttggcatttccattataaaaaataagtgcaatcaacaaacagatcgtcagctttcgtttcatgcaggtccctcccactctctctccttacagaatatgaagaaagggacaaggatagaccaacattgtctttacatcagctcaagcttcgtttgctttttcgagaccacaagaaagtaagcaagcccgattgaaaagatgcttagccaaaatgttccgtatcctatttcagtcatataatcagaaagcatagagtattgcggcatcatatcaaacaagtagtcaatgacatcgttatgcagtgtccagactgcagcaattgcaagatgccaaaatgaaaaacgaaaatacggactgtataatacgccttgaactgccattgcaaaatgcgaagcaattagcatgtagccctcccacggcaagtcaccagttactgcaagcacaagaaaattcatagccaccgcccataggccatactttacgagggtaactagcgcaagcgcctcaaagagcggagcattccgtttcatgagaaaggcaagcagcacaaacagaaagaaaaacgttgctgtcggactgtccggaacaaaaatcaggaaacgggccggtgtctccaaaagctgcggcaagtaccaatagtagccgtaaaccgttcccagaaaattaatggctaagacaagaataagtatcggccgctgccctaatacatattgaaaccatttcacatcgaatcaactctcagtctgtaaaaataatatgtccatataaaaaagctgacgccgggtcagcttttgataataaaagtatatccttccatttgacaattcacaatacgttattttgcggttgtttcagaaataaattttgcaagttcttcgagctgcttatcatttcctttgaacacacccgccggcattttgccttttccttctacagcgatttttttgatttcttccggtttcagcccgctgtcaaccaatgaaggcccagccgctcctccctgaaggttatccccatggcaagaaatacagccctgttccttaaagaccttatatccttctgcattggtgtcaatgtcggcttcttttgtgattttcccctgttcttctgccttggcccagtcatgagtagcaactgactgccacgtcaaaaatacagcagcggaaatggccagaagcatcataccgacagcgaccggacgcttccacggccttctttctgtccctctgtctaggaatggagccaaaagcagggccccaaaagcgagacctggcataatcatggcgccgaccactgtaaagcttccagcggcgtattcatacttcaacagctggtataagaaaagaaaataccaatccggcagcggaatataaccagtatcagtcgggtccgccatccgctccaaaggcggctgatgcacaatcgtcaaaacgagaaaaccgatgagaaagacagctccaaccatccattcctttaacaagaaatttggccagaaagcctctgttttaccggatactccgaataatccttcggtatattcggctttttttcagccggtatccttgagtcgcctacaaatttcatccctttgccccggtgcatgtcatcccctcccttttattcgcagatcaagagtttaaagcggtcctgaaattccctgcttccggatcataataaaatgtgcagccatcagcccgaacaatgcggcaggaagaaaaaatacatggatcgcaaaaaacctagtcagcgtttgggcgcctacaatatccggatgccctgcaaggagcgttttaacctgcgttccgatcaaaggcgtggcttcggcgatctgcagcccgacttttgttgcaaacagagccttcatatcccaaggaagcaagtagcctgtaaagccaagaccgagcataacaaaaaagatcagcacaccgacaatccagttcagctcgcgcggttttttatacgcgccttggaaaaagaccctcagcgtatgtaaaaacatcatcacaatgaccaggctcgcaccccagtggtgcatccccctgacaatctggccgaatgctacttcattttgcaaataatataccgattcccaggcatttttgatatcaggcacataatacatcgttaaaaacattccagataatacttggataacggttacaaaaaacgtcagtcccccaaagcaatacacaaacgcagagaaatgatgggcgggattcacatgttccggtacttcgtgatcggcaatatccctccacatcggtgtaatatcaagccgctcgtctacccagtcataaattttgttcagcatgtcacccttcccccttaggctttgcttttccaagatacaggaagccgtcttttacttcttgctcataatgatcaagaggcgcaagcggcggcgtgccagggacattggtgccgtccttttcatagagtccgtaatggcatggacaaaagaatttattcgggtttttaggatcactattccagttcaccgtacaccctaaatgtttacaaattggcgaaagtgctacaatttcatccccgtttttgaagacccaggctgatcttgactcttctgactcataccaggcatcgacttgattaattttaaaatcaaagcgctgcggctcttttgtcaactcatcaacgctgacaacctgaaccatatcctgcttccctgtcgattttaataccgggtcgagtgcgaagcgaaccataggcatgagcatactagccgccataaaacctcctacgcctgtgagcgtgtaattcaaaaattgacgtctggatatatcatgttttccgcccatctcttctccccctctaggtacccctgcaaactaactaaaatagaaaatattgcaataactctagacaccctcataatatatgaatctctcagcaaggtcaatatagccaaaatattgtttataaggaatgtaagtgtttttatgaagtgctccataactgtaacaaaacgttcaaaatttcagcagtgcgttcatccaatatttttctttttaaagagtcatttaaatgctctaatggaacagacggtgtaacaatgattttgcctaacgcatcctcagctctccaactttcgtcagatgtgagcaggacaacatgcggaaattccgttatcagctcttccgcaaatccttaagcccttgaacggttatttcatttctatcaacatatgtataaggcggaagtaaatatacccgtccctttaactgcctttcaagttcttctgagagaagctgcgtaaactcgcctttctccgccgccattttaaaatggttattaacccttatgttaattaatggcatgacagcggtatcaatgtaatccttagcttgtaaatagtccttggcatcagtgattctccacctcatcgttctccccctttacggcaacaagccttgcaattcactgcaaggctggtcatattatgtgagctgatttaattggcgcgataattgttcaaatgcctctttatcatgacgatctaacgcgtcgtcaatgtcttttaataatttttctctttggaatgtggaaatagcgtgctctaaaatctgttccgccaatccctgatcttttttattctcaaaaaggtttttcggaatatgcgggttggactccagcaccgccgcatattcaggtgagctgtaagcgaacggaaattaagctggataaacaaatctgctgtttatttaatctaatatcatgaaaagatttttccgcgtcggtagtcatgacattctctttatagaaccggaacggaacttcttcaacacatgtgttgacattataatgcctctcgg
